United States Patent
Dockal et al.

(10) Patent No.: US 9,447,147 B2
(45) Date of Patent: Sep. 20, 2016

(54) PEPTIDES AND METHODS OF USE

(71) Applicants: BAXTER INTERNATIONAL INC., Deerfield, IL (US); BAXTER HEALTHCARE SA, Glattpark (Opfikon) (CH)

(72) Inventors: Michael Dockal, Vienna (AT); Thomas Polakowski, Berlin (DE); Frank Osterkamp, Berlin (DE); Rudolf Hartmann, Bisamberg (AT); Matthias Paschke, Berlin (DE); Bettina Hartlieb, Vienna (AT); Friedrich Scheiflinger, Vienna (AT)

(73) Assignees: BAXALTA GMBH, Glattpark (Opfikon) (CH); BAXALTA INCORPORATED, Bannockburn, IL (US)

( * ) Notice: Subject to any disclaimer, the term of this patent is extended or adjusted under 35 U.S.C. 154(b) by 0 days.

(21) Appl. No.: 14/634,028

(22) Filed: Feb. 27, 2015

(65) Prior Publication Data

US 2015/0246947 A1 Sep. 3, 2015

Related U.S. Application Data

(60) Provisional application No. 61/946,103, filed on Feb. 28, 2014.

(51) Int. Cl.
| | |
|---|---|
| C07K 7/08 | (2006.01) |
| A61K 38/10 | (2006.01) |
| A61K 47/48 | (2006.01) |
| C07K 14/745 | (2006.01) |
| A61K 38/00 | (2006.01) |

(52) U.S. Cl.
CPC ............... *C07K 7/08* (2013.01); *A61K 38/10* (2013.01); *A61K 47/48215* (2013.01); *C07K 14/745* (2013.01); *A61K 38/00* (2013.01)

(58) Field of Classification Search
None
See application file for complete search history.

(56) References Cited

U.S. PATENT DOCUMENTS

2013/0252896 A1 9/2013 Dockal et al.

FOREIGN PATENT DOCUMENTS

| WO | WO-2011/115712 A2 | 9/2011 |
| WO | WO-2011/125015 A2 | 10/2011 |

OTHER PUBLICATIONS

Linse et al., A region of vitamin K-dependent protein S that binds to C4b binding protein (C4BP) identified using bacteriophage peptide display libraries. *J. Biol. Chem.* 272(23): 14658-65 (1997).
International Search Report and Written Opinion of the International Searching Authority issued in connection with International Application No. PCT/US2015/018041, dated Jun. 1, 2015.
Dahlback, "Advances in understanding pathogenic mechanisms of thrombophilic disorders", *Blood*, 112: 19-27 (2008).
Franchini et al., "Factor V Leiden and hemophilia", *Thromb. Res.*, 125: 119-23 (2010).
Hackeng et al., "Human protein S inhibits prothrombinase complex activity on endothelial cells and platelets via direct interactions with factor Va and Xa", *J. Biol. Chem.*, 269(33): 21051-8 (1994).
Rezende et al., "Coagulation, inflammation, and apoptosis: Different roles for protein S and the protein S-C4b binding protein complex", *Blood*, 103: 1192-201 (2004).
Rosing et al., "Effects of protein S and factor Xa on peptide bond cleavages during inactivation of factor Va and factor VaR506Q by activated protein C", *J. Biol. Chem.*, 270(46): 27852-8 (1995).
Sere et al., "Inhibition of thrombin generation by protein S at low procoagulant stimuli: Implications for maintenance of the hemostatic balance", *Blood*, 104: 3624-30 (2004).
van't Veer et al., "Increased prothrombin activation in protein S-deficient plasma under flow conditions on endothelial cell matrix: An independent anticoagulant function of protein S in plasma", *Blood*, 85: 1815-21 (1995).
Walker et al., Regulation of activated protein C by protein S. The role of phospholipid in factor Va inactivation, *J. Biol. Chem.*, 256(21): 11128-31 (1981).

*Primary Examiner* — Christina Bradley
*Assistant Examiner* — Ronald Niebauer
(74) *Attorney, Agent, or Firm* — Marshall, Gerstein & Borun LLP

(57) ABSTRACT

The invention provides peptides, including peptides that bind and, optionally, inhibit Protein S, and compositions thereof. The peptides may be used to, e.g., inhibit Protein S activity, enhance thrombin formation in a subject, increase blood clot formation in a subject, treat a blood coagulation disorder in a subject, purify Protein S, and identify a Protein S binding compound.

9 Claims, 39 Drawing Sheets

| SEQ ID | Peptide | Mean IC50 [nM] | SEQ ID | Peptide | Mean IC50 [nM] | SEQ ID | Peptide | Mean IC50 [nM] |
|---|---|---|---|---|---|---|---|---|
| 2 | JBS2512 | 21.5 | 149 | JBS2659 | 16.4 | 195 | JBS2731 | 4337.0 |
| 6 | JBS2516 | 9.9 | 151 | JBS2661 | 7.8 | 196 | JBS2732 | 10265.9 |
| 18 | JBS2528 | 18.8 | 153 | JBS2663 | 28.4 | 197 | JBS2733 | 110.9 |
| 36 | JBS2546 | 31.0 | 165 | JBS2676 | 11.6 | 198 | JBS2734 | 792.0 |
| 42 | JBS2552 | 16.6 | 167 | JBS2678 | 1811.3 | 204 | JBS2740 | 16.4 |
| 60 | JBS2570 | 18.8 | 168 | JBS2679 | 30.0 | 214 | JBS2750 | 3.6 |
| 62 | JBS2572 | 10.0 | 169 | JBS2680 | 6.0 | 216 | JBS2752 | 6.8 |
| 72 | JBS2582 | 7.4 | 170 | JBS2681 | 18.7 | 234 | JBS2770 | 5.2 |
| 76 | JBS2586 | 11.0 | 171 | JBS2682 | 7.5 | 252 | JBS2788 | 2.2 |
| 80 | JBS2590 | 11.4 | 172 | JBS2683 | 5.6 | 254 | JBS2790 | 3.4 |
| 82 | JBS2592 | 20.0 | 173 | JBS2684 | 12.5 | 258 | JBS2794 | 5.6 |
| 92 | JBS2602 | 10.9 | 183 | JBS2713 | 20.1 | 258 | JBS2794 | 4.0 |
| 100 | JBS2610 | 15.5 | 185 | JBS2721 | 3.6 | 270 | JBS2806 | 5.7 |
| 101 | JBS2611 | 12.5 | 186 | JBS2722 | 24.4 | 274 | JBS2810 | 4.4 |
| 102 | JBS2612 | 17.0 | 187 | JBS2723 | 1493.3 | 274 | JBS2810 | 5.5 |
| 113 | JBS2623 | 15.1 | 188 | JBS2724 | 13.9 | 287 | JBS2823 | 13.5 |
| 115 | JBS2625 | 6.6 | 189 | JBS2725 | 5897.9 | 289 | JBS2825 | 4.4 |
| 118 | JBS2628 | 27.0 | 190 | JBS2726 | 15691.4 | 288 | JBS2845 | 8.4 |
| 135 | JBS2645 | 9.4 | 191 | JBS2727 | 7.6 | 311 | JBS2847 | 5.4 |
| 138 | JBS2648 | 18.6 | 192 | JBS2728 | 8.4 | 349 | JBS2885 | 4.4 |
| 139 | JBS2649 | 31.8 | 193 | JBS2729 | 6.2 | 351 | JBS2887 | 4.0 |
| 140 | JBS2650 | 25.1 | 194 | JBS2730 | 13751.7 | 367 | JBS2903 | 3.1 |
| 369 | JBS2905 | 5.9 | 442 | JBS3190 | 1.6 | 467 | JBS3221 | 0.6 |
| 388 | JBS2924 | 3.6 | 443 | JBS3191 | 1.6 | 468 | JBS3222 | 1.5 |

FIGURE 1A

| SEQ ID | Peptide | Mean IC50 [nM] | SEQ ID | Peptide | Mean IC50 [nM] | SEQ ID | Peptide | Mean IC50 [nM] |
|---|---|---|---|---|---|---|---|---|
| 392 | JBS2928 | 3.7 | 444 | JBS3192 | 2.8 | 469 | JBS3223 | 0.7 |
| 405 | JBS2941 | 1.4 | 445 | JBS3193 | 2.7 | 470 | JBS3224 | 1.3 |
| 409 | JBS3152 | 5.1 | 446 | JBS3194 | 2.0 | 477 | JBS3231 | 1.5 |
| 409 | JBS3152 | 4.4 | 447 | JBS3195 | 2.1 | 478 | JBS3232 | 0.9 |
| 412 | JBS3157 | 812.0 | 448 | JBS3196 | 2.5 | 479 | JBS3233 | 0.9 |
| 415 | JBS3160 | 981.4 | 449 | JBS3197 | 6.1 | 480 | JBS3234 | 2.7 |
| 417 | JBS3162 | 1508.3 | 450 | JBS3198 | 2.5 | 481 | JBS3235 | 1.4 |
| 423 | JBS3168 | 604.4 | 451 | JBS3199 | 2.4 | 482 | JBS3236 | 2.6 |
| 424 | JBS3169 | 543.9 | 452 | JBS3200 | 4.8 | 483 | JBS3237 | 1.5 |
| 425 | JBS3170 | 205.7 | 453 | JBS3201 | 1.8 | 484 | JBS3238 | 1.3 |
| 426 | JBS3171 | 335.6 | 454 | JBS3202 | 1.6 | 485 | JBS3239 | 2.0 |
| 427 | JBS3172 | 55.2 | 455 | JBS3203 | 1.8 | 486 | JBS3240 | 2.0 |
| 428 | JBS3173 | 207.5 | 457 | JBS3205 | 4.3 | 487 | JBS3241 | 1.2 |
| 433 | JBS3179 | 8.0 | 458 | JBS3206 | 0.8 | 488 | JBS3242 | 67.8 |
| 434 | JBS3180 | 9.0 | 460 | JBS3208 | 11.1 | 489 | JBS3243 | 1.3 |
| 435 | JBS3181 | 9.5 | 461 | JBS3215 | 0.8 | 490 | JBS3244 | 4.7 |
| 436 | JBS3182 | 20.9 | 462 | JBS3216 | 0.7 | 491 | JBS3245 | 2.0 |
| 437 | JBS3185 | 7.2 | 463 | JBS3217 | 1.3 | 492 | JBS3246 | 2.2 |
| 438 | JBS3186 | 2.6 | 464 | JBS3218 | 0.9 | 493 | JBS3247 | 1.9 |
| 440 | JBS3188 | 2.9 | 465 | JBS3219 | 1.1 | 494 | JBS3248 | 3.7 |
| 441 | JBS3189 | 5.0 | 466 | JBS3220 | 3.5 | 496 | JBS3250 | 22.7 |
| 497 | JBS3251 | 0.6 | 519 | JBS3273 | 2.3 | 541 | JBS3295 | 14.6 |
| 498 | JBS3252 | 12.8 | 520 | JBS3274 | 1.0 | 542 | JBS3296 | 2.2 |

FIGURE 1B

| SEQ ID | Peptide | Mean IC50 [nM] | SEQ ID | Peptide | Mean IC50 [nM] | SEQ ID | Peptide | Mean IC50 [nM] |
|---|---|---|---|---|---|---|---|---|
| 499 | JBS3253 | 2.8 | 521 | JBS3275 | 1.2 | 543 | JBS3297 | 1.0 |
| 500 | JBS3254 | 1.6 | 522 | JBS3276 | 3.0 | 544 | JBS3298 | 1.0 |
| 501 | JBS3255 | 9.5 | 523 | JBS3277 | 3.4 | 545 | JBS3299 | 2.0 |
| 502 | JBS3256 | 1.7 | 524 | JBS3278 | 1.1 | 546 | JBS3300 | 3.2 |
| 503 | JBS3257 | 14.8 | 525 | JBS3279 | 1.5 | 547 | JBS3301 | 1.3 |
| 504 | JBS3258 | 0.9 | 526 | JBS3280 | 5.3 | 548 | JBS3302 | 3.5 |
| 504 | JBS3258 | 0.8 | 527 | JBS3281 | 2.3 | 549 | JBS3303 | 1.7 |
| 505 | JBS3259 | 3.7 | 527 | JBS3281 | 1.7 | 550 | JBS3304 | 1.5 |
| 506 | JBS3260 | 1.6 | 528 | JBS3282 | 4.1 | 551 | JBS3305 | 3.7 |
| 507 | JBS3261 | 2.0 | 529 | JBS3283 | 0.9 | 552 | JBS3306 | 0.8 |
| 508 | JBS3262 | 1.0 | 530 | JBS3284 | 1.3 | 553 | JBS3307 | 1.4 |
| 509 | JBS3263 | 1.2 | 531 | JBS3285 | 1.2 | 554 | JBS3308 | 1.4 |
| 510 | JBS3264 | 2.0 | 532 | JBS3286 | 1.3 | 555 | JBS3309 | 1.1 |
| 511 | JBS3265 | 1.4 | 533 | JBS3287 | 1.2 | 560 | JBS3314 | 0.8 |
| 512 | JBS3266 | 1.6 | 534 | JBS3288 | 3.1 | 563 | JBS3317 | 0.6 |
| 513 | JBS3267 | 1.7 | 535 | JBS3289 | 2.5 | 564 | JBS3318 | 2.8 |
| 514 | JBS3268 | 1.5 | 536 | JBS3290 | 3.4 | 566 | JBS3320 | 0.5 |
| 515 | JBS3269 | 56.9 | 537 | JBS3291 | 8.0 | 567 | JBS3321 | 0.7 |
| 516 | JBS3270 | 1.2 | 538 | JBS3292 | 2.7 | 568 | JBS3322 | 4.5 |
| 517 | JBS3271 | 1.9 | 539 | JBS3293 | 2.1 | 571 | JBS3325 | 0.7 |
| 518 | JBS3272 | 1.4 | 540 | JBS3294 | 6.3 | 572 | JBS3326 | 1.0 |
| 999 | JBS3754 | 3.2 | 1000 | JBS3755 | 7.6 | 1001 | JBS3756 | 10.1 |
| 1002 | JBS3757 | 26.5 | 1003 | JBS3758 | 0.9 | 1005 | JBS3761 | 2.8 |

FIGURE 1C

| SEQ ID | Compound | Sequence | SEQ ID | Compound | Sequence |
| --- | --- | --- | --- | --- | --- |
| 1 | JBS-0684 | Bio-Ttds-TGHVSAGWYDYNFDHYREFT-NH₂ | 42 | JBS-2552 | Ac-GGHVSAGWYDYNFDHYREFT-NH2 |
| 2 | JBS-2512 | Ac-TGHVSAGWYDYNFDHYREFT-NH2 | 43 | JBS-2553 | Ac-TGGVSAGWYDYNFDHYREFT-NH2 |
| 3 | JBS-2513 | Ac-ATFYGTNHFVERDWHSDYYG-NH2 | 44 | JBS-2554 | Ac-TGHGSAGWYDYNFDHYREFT-NH2 |
| 4 | JBS-2514 | Ac-WYFYTGDHEHSFNVGYARDT-NH2 | 45 | JBS-2555 | Ac-TGHVGAGWYDYNFDHYREFT-NH2 |
| 5 | JBS-2515 | Ac-AGHVSAGWYDYNFDHYREFT-NH2 | 46 | JBS-2556 | Ac-TGHVSGGWYDYNFDHYREFT-NH2 |
| 6 | JBS-2516 | Ac-TAHVSAGWYDYNFDHYREFT-NH2 | 47 | JBS-2557 | Ac-TGHVSAGGYDYNFDHYREFT-NH2 |
| 7 | JBS-2517 | Ac-TGAVSAGWYDYNFDHYREFT-NH2 | 48 | JBS-2558 | Ac-TGHVSAGWGDYNFDHYREFT-NH2 |
| 8 | JBS-2518 | Ac-TGHASAGWYDYNFDHYREFT-NH2 | 49 | JBS-2559 | Ac-TGHVSAGWYGNFDHYREFT-NH2 |
| 9 | JBS-2519 | Ac-TGHVAAGWYDYNFDHYREFT-NH2 | 50 | JBS-2560 | Ac-TGHVSAGWYDGNFDHYREFT-NH2 |
| 10 | JBS-2520 | Ac-TGHVSAAWYDYNFDHYREFT-NH2 | 51 | JBS-2561 | Ac-TGHVSAGWYDYGFDHYREFT-NH2 |
| 11 | JBS-2521 | Ac-TGHVSAGAYDYNFDHYREFT-NH2 | 52 | JBS-2562 | Ac-TGHVSAGWYDYNGDHYREFT-NH2 |
| 12 | JBS-2522 | Ac-TGHVSAGWADYNFDHYREFT-NH2 | 53 | JBS-2563 | Ac-TGHVSAGWYDYNFDGYREFT-NH2 |
| 13 | JBS-2523 | Ac-TGHVSAGWYAYNFDHYREFT-NH2 | 54 | JBS-2564 | Ac-TGHVSAGWYDYNFDHGREFT-NH2 |
| 14 | JBS-2524 | Ac-TGHVSAGWYDANFDHYREFT-NH2 | 55 | JBS-2565 | Ac-TGHVSAGWYDYNFDHYGEFT-NH2 |
| 15 | JBS-2525 | Ac-TGHVSAGWYDYAFDHYREFT-NH2 | 56 | JBS-2566 | Ac-TGHVSAGWYDYNFDHYRGFT-NH2 |
| 16 | JBS-2526 | Ac-TGHVSAGWYDYNADHYREFT-NH2 | 57 | JBS-2567 | Ac-TGHVSAGWYDYNFDHYRGFT-NH2 |
| 17 | JBS-2527 | Ac-TGHVSAGWYDYNFAHYREFT-NH2 | 58 | JBS-2568 | Ac-TGHVSAGWYDYNFDHYREGT-NH2 |
| 18 | JBS-2528 | Ac-TGHVSAGWYDYNFDAYREFT-NH2 | 59 | JBS-2569 | Ac-TGHVSAGWYDYNFDHYREFG-NH2 |
| 19 | JBS-2529 | Ac-TGHVSAGWYDYNFDHAREFT-NH2 | 60 | JBS-2570 | Ac-LGHVSAGWYDYNFDHYREFT-NH2 |
| 20 | JBS-2530 | Ac-TGHVSAGWYDYNFDHYAEFT-NH2 | 61 | JBS-2571 | Ac-TLHVSAGWYDYNFDHYREFT-NH2 |
| 21 | JBS-2531 | Ac-TGHVSAGWYDYNFDHYRAFT-NH2 | 62 | JBS-2572 | Ac-TGHLSAGWYDYNFDHYREFT-NH2 |
| 22 | JBS-2532 | Ac-TGHVSAGWYDYNFDHYREAT-NH2 | 63 | JBS-2573 | Ac-TGHVLAGWYDYNFDHYREFT-NH2 |
| 23 | JBS-2533 | Ac-TGHVSAGWYDYNFDHYREFA-NH2 | 64 | JBS-2574 | Ac-TGHVSLGWYDYNFDHYREFT-NH2 |
| 24 | JBS-2534 | Ac-DGHVSAGWYDYNFDHYREFT-NH2 | 65 | JBS-2575 | Ac-TGHVSALWYDYNFDHYREFT-NH2 |
| 25 | JBS-2535 | Ac-TDHVSAGWYDYNFDHYREFT-NH2 | 66 | JBS-2576 | Ac-TGHVSAGLYDYNFDHYREFT-NH2 |
| 26 | JBS-2536 | Ac-TGDVSAGWYDYNFDHYREFT-NH2 | 67 | JBS-2577 | Ac-TGHVSAGWLDYNFDHYREFT-NH2 |
| 27 | JBS-2537 | Ac-TGHDSAGWYDYNFDHYREFT-NH2 | 68 | JBS-2578 | Ac-TGHVSAGWYLNFDHYREFT-NH2 |
| 28 | JBS-2538 | Ac-TGHVDAGWYDYNFDHYREFT-NH2 | 69 | JBS-2579 | Ac-TGHVSAGWYDLNFDHYREFT-NH2 |
| 29 | JBS-2539 | Ac-TGHVSDGWYDYNFDHYREFT-NH2 | 70 | JBS-2580 | Ac-TGHVSAGWYDYLFDHYREFT-NH2 |
| 30 | JBS-2540 | Ac-TGHVSADWYDYNFDHYREFT-NH2 | 71 | JBS-2581 | Ac-TGHVSAGWYDYNLDHYREFT-NH2 |
| 31 | JBS-2541 | Ac-TGHVSAGDYDYNFDHYREFT-NH2 | 72 | JBS-2582 | Ac-TGHVSAGWYDYNFLHYREFT-NH2 |
| 32 | JBS-2542 | Ac-TGHVSAGWDDYNFDHYREFT-NH2 | 73 | JBS-2583 | Ac-TGHVSAGWYDYNFDLYREFT-NH2 |
| 33 | JBS-2543 | Ac-TGHVSAGWYDDNFDHYREFT-NH2 | 74 | JBS-2584 | Ac-TGHVSAGWYDYNFDHLREFT-NH2 |
| 34 | JBS-2544 | Ac-TGHVSAGWYDDFDHYREFT-NH2 | 75 | JBS-2585 | Ac-TGHVSAGWYDYNFDHLREFT-NH2 |
| 35 | JBS-2545 | Ac-TGHVSAGWYDYNDDHYREFT-NH2 | | | |
| 36 | JBS-2546 | Ac-TGHVSAGWYDYNFDDYREFT-NH2 | | | |
| 37 | JBS-2547 | Ac-TGHVSAGWYDYNFDHDREFT-NH2 | | | |
| 38 | JBS-2548 | Ac-TGHVSAGWYDYNFDHDEFT-NH2 | | | |
| 39 | JBS-2549 | Ac-TGHVSAGWYDYNFDHYRDFT-NH2 | | | |
| 40 | JBS-2550 | Ac-TGHVSAGWYDYNFDHYREDT-NH2 | | | |
| 41 | JBS-2551 | Ac-TGHVSAGWYDYNFDHYREFD-NH2 | | | |

FIGURE 2A

| SEQ ID | Compound | Sequence | SEQ ID | Compound | Sequence |
|---|---|---|---|---|---|
| 76 | JBS-2586 | Ac-TGHVSAGWYDYNFDHYLEFT-NH2 | 117 | JBS-2627 | Ac-TGHVSAGWYDYNFDHYREFF-NH2 |
| 77 | JBS-2587 | Ac-TGHVSAGWYDYNFDHYRLFT-NH2 | 118 | JBS-2628 | Ac-PGHVSAGWYDYNFDHYREFT-NH2 |
| 78 | JBS-2588 | Ac-TGHVSAGWYDYNFDHYRELT-NH2 | 119 | JBS-2629 | Ac-TFHVSAGWYDYNFDHYREFT-NH2 |
| 79 | JBS-2589 | Ac-TGHVSAGWYDYNFDHYREFL-NH2 | 120 | JBS-2630 | Ac-TGPVSAGWYDYNFDHYREFT-NH2 |
| 80 | JBS-2590 | Ac-KGHVSAGWYDYNFDHYREFT-NH2 | 121 | JBS-2631 | Ac-TGHPSAGWYDYNFDHYREFT-NH2 |
| 81 | JBS-2591 | Ac-TKHVSAGWYDYNFDHYREFT-NH2 | 122 | JBS-2632 | Ac-TGHVPAGWYDYNFDHYREFT-NH2 |
| 82 | JBS-2592 | Ac-TGKVSAGWYDYNFDHYREFT-NH2 | 123 | JBS-2633 | Ac-TGHVSPGWYDYNFDHYREFT-NH2 |
| 83 | JBS-2593 | Ac-TGHKSAGWYDYNFDHYREFT-NH2 | 124 | JBS-2634 | Ac-TGHVSAPWYDYNFDHYREFT-NH2 |
| 84 | JBS-2594 | Ac-TGHVKAGWYDYNFDHYREFT-NH2 | 125 | JBS-2635 | Ac-TGHVSAGPYDYNFDHYREFT-NH2 |
| 85 | JBS-2595 | Ac-TGHVSKGWYDYNFDHYREFT-NH2 | 126 | JBS-2636 | Ac-TGHVSAGWPDYNFDHYREFT-NH2 |
| 86 | JBS-2596 | Ac-TGHVSAKWYDYNFDHYREFT-NH2 | 127 | JBS-2637 | Ac-TGHVSAGWYPYNFDHYREFT-NH2 |
| 87 | JBS-2597 | Ac-TGHVSAGKYDYNFDHYREFT-NH2 | 128 | JBS-2638 | Ac-TGHVSAGWYDPNFDHYREFT-NH2 |
| 88 | JBS-2598 | Ac-TGHVSAGWKDYNFDHYREFT-NH2 | 129 | JBS-2639 | Ac-TGHVSAGWYDYPFDHYREFT-NH2 |
| 89 | JBS-2599 | Ac-TGHVSAGWYKYNFDHYREFT-NH2 | 130 | JBS-2640 | Ac-TGHVSAGWYDYNPDHYREFT-NH2 |
| 90 | JBS-2600 | Ac-TGHVSAGWYDKNFDHYREFT-NH2 | 131 | JBS-2641 | Ac-TGHVSAGWYDYNFPHYREFT-NH2 |
| 91 | JBS-2601 | Ac-TGHVSAGWYDYKFDHYREFT-NH2 | 132 | JBS-2642 | Ac-TGHVSAGWYDYNFDPYREFT-NH2 |
| 92 | JBS-2602 | Ac-TGHVSAGWYDYNKDHYREFT-NH2 | 133 | JBS-2643 | Ac-TGHVSAGWYDYNFDHPREFT-NH2 |
| 93 | JBS-2603 | Ac-TGHVSAGWYDYNFKHYREFT-NH2 | 134 | JBS-2644 | Ac-TGHVSAGWYDYNFDHYPEFT-NH2 |
| 94 | JBS-2604 | Ac-FGHVSAGWYDYNFDKYREFT-NH2 | 135 | JBS-2645 | Ac-TGHVSAGWYDYNFDHYRPFT-NH2 |
| 95 | JBS-2605 | Ac-TFHVSAGWYDYNFDHKREFT-NH2 | 136 | JBS-2646 | Ac-TGHVSAGWYDYNFDHYREPT-NH2 |
| 96 | JBS-2606 | Ac-TGFVSAGWYDYNFDHYKEFT-NH2 | 137 | JBS-2647 | Ac-TGHVSAGWYDYNFDHYREFP-NH2 |
| 97 | JBS-2607 | Ac-TGHFSAGWYDYNFDHYRKFT-NH2 | 138 | JBS-2648 | Ac-SGHVSAGWYDYNFDHYREFT-NH2 |
| 98 | JBS-2608 | Ac-TGHVFAGWYDYNFDHYREKT-NH2 | 139 | JBS-2649 | Ac-TSHVSAGWYDYNFDHYREFT-NH2 |
| 99 | JBS-2609 | Ac-TGHVSFGWYDYNFDHYREFK-NH2 | 140 | JBS-2650 | Ac-TGSVSAGWYDYNFDHYREFT-NH2 |
| 100 | JBS-2610 | Ac-TGHVSAFWYDYNFDHYREKT-NH2 | 141 | JBS-2651 | Ac-TGHSSAGWYDYNFDHYREFT-NH2 |
| 101 | JBS-2611 | Ac-FGHVSAGWYDYNFDHYREFT-NH2 | 142 | JBS-2652 | Ac-TGHVSSGWYDYNFDHYREFT-NH2 |
| 102 | JBS-2612 | Ac-TGFVSAGWYDYFFDHYREFT-NH2 | 143 | JBS-2653 | Ac-TGHVSASWYDYNFDHYREFT-NH2 |
| 103 | JBS-2613 | Ac-TGHFSAGWYDYNFFHYREFT-NH2 | 144 | JBS-2654 | Ac-TGHVSAGSYDYNFDHYREFT-NH2 |
| 104 | JBS-2614 | Ac-TGHVFAGWYDYNFDFYREFT-NH2 | 145 | JBS-2655 | Ac-TGHVSAGWSDYNFDHYREFT-NH2 |
| 105 | JBS-2615 | Ac-TGHVSFGWYDYNFDHFREFT-NH2 | 146 | JBS-2656 | Ac-TGHVSAGWYSYNFDHYREFT-NH2 |
| 106 | JBS-2616 | Ac-TGHVSAFWYDYNFDHYFEFT-NH2 | 147 | JBS-2657 | Ac-TGHVSAGWYDSNFDHYREFT-NH2 |
| 107 | JBS-2617 | Ac-TGHVSAGFYDYNFDHYRFFT-NH2 | 148 | JBS-2658 | Ac-TGHVSAGWYDYSFDHYREFT-NH2 |
| 108 | JBS-2618 | Ac-TGHVSAGWFDYNFDHYREFT-NH2 | 149 | JBS-2659 | Ac-TGHVSAGWYDYNSDHYREFT-NH2 |
| 109 | JBS-2619 | Ac-TGHVSAGWYFYNFDHYREFT-NH2 | 150 | JBS-2660 | Ac-TGHVSAGWYDYNFSHYREFT-NH2 |
| 110 | JBS-2620 | Ac-TGHVSAGWYDFNFDHYREFT-NH2 | 151 | JBS-2661 | Ac-TGHVSAGWYDYNFDSYREFT-NH2 |
| 111 | JBS-2621 | Ac-TGHVSAGWYDYFFDHYREFT-NH2 | 152 | JBS-2662 | Ac-TGHVSAGWYDYNFDHSREFT-NH2 |
| 112 | JBS-2622 | Ac-TGHVSAGWYDYNFFHYREFT-NH2 | 153 | JBS-2663 | Ac-TGHVSAGWYDYNFDHYSEFT-NH2 |
| 113 | JBS-2623 | Ac-TGHVSAGWYDYNFDFYREFT-NH2 | 154 | JBS-2664 | Ac-TGHVSAGWYDYNFDHYRSFT-NH2 |
| 114 | JBS-2624 | Ac-TGHVSAGWYDYNFDHFREFT-NH2 | 155 | JBS-2665 | Ac-TGHVSAGWYDYNFDHYREST-NH2 |
| 115 | JBS-2625 | Ac-TGHVSAGWYDYNFDHYFEFT-NH2 | 156 | JBS-2666 | Ac-TGHVSAGWYDYNFDHYREFS-NH2 |
| 116 | JBS-2626 | Ac-TGHVSAGWYDYNFDHYRFFT-NH2 | 157 | JBS-2667 | Ac-TGHVSAGWYDYNFDHYR-NH2 |

FIGURE 2B

| SEQ ID | Compound | Sequence | SEQ ID | Compound | Sequence |
|---|---|---|---|---|---|
| 158 | JBS-2668 | Ac-TGHVSAGWYDYNFD-NH2 | 199 | JBS-2735 | Ac-TGHVSAGWYDYNFDHYREFT-Ttds-K(Bio)-NH2 |
| 159 | JBS-2669 | Ac-TGHVSAGWYDYNFDY-NH2 | 200 | JBS-2736 | Ac-BGLVSAGWYDYNFDHYREFT-NH2 |
| 160 | JBS-2670 | Ac-VSAGWYDYNFDHYREFT-NH2 | 201 | JBS-2737 | Ac-TELVSAGWYDYNFDHYREFT-NH2 |
| 161 | JBS-2671 | Ac-GWYDYNFDHYREFT-NH2 | 202 | JBS-2738 | Ac-TGEVSAGWYDYNFDHYREFT-NH2 |
| 162 | JBS-2672 | Ac-DYNFDHYREFT-NH2 | 203 | JBS-2739 | Ac-TGLESAGWYDYNFDHYREFT-NH2 |
| 163 | JBS-2673 | Ac-VSAGWYDYNFDHYR-NH2 | 204 | JBS-2740 | Ac-TGLVEAGWYDYNFDHYREFT-NH2 |
| 164 | JBS-2674 | Ac-GWYDYNFD-NH2 | 205 | JBS-2741 | Ac-TGLVSEGWYDYNFDHYREFT-NH2 |
| 165 | JBS-2676 | Ac-GGHVSAGWYDYNKDHYREFT-NH2 | 206 | JBS-2742 | Ac-TGLVSAEWYDYNFDHYREFT-NH2 |
| 166 | JBS-2677 | Ac-TGHVSAGWYDYNFDHYREF-NH2 | 207 | JBS-2743 | Ac-TGLVSAGEYDYNFDHYREFT-NH2 |
| 167 | JBS-2678 | Ac-TGHVSAGWYDYNFDHYRE-NH2 | 208 | JBS-2744 | Ac-TGLVSAGWEDYNFDHYREFT-NH2 |
| 168 | JBS-2679 | Ac-TAHVSAGWYDYNFDDYREFT-NH2 | 209 | JBS-2745 | Ac-TGLVSAGWEYNFDHYREFT-NH2 |
| 169 | JBS-2680 | Ac-TAHVSAGWYDYNFDLYREFT-NH2 | 210 | JBS-2746 | Ac-TGLVSAGWYDENFDHYREFT-NH2 |
| 170 | JBS-2681 | Ac-GAHVSAGWYDYNFDLYREFT-NH2 | 211 | JBS-2747 | Ac-TGLVSAGWYDYEFDHYREFT-NH2 |
| 171 | JBS-2682 | Ac-GGHVSAGWYDYNFDDYREFT-NH2 | 212 | JBS-2748 | Ac-TGLVSAGWYDYNEDHYREFT-NH2 |
| 172 | JBS-2683 | Ac-GGHVSAGWYDYNFDLYREFT-NH2 | 213 | JBS-2749 | Ac-TGLVSAGWYDYNFEHYREFT-NH2 |
| 173 | JBS-2684 | Ac-GGHVSAGWYDYNADHYREFT-NH2 | 214 | JBS-2750 | Ac-TGLVSAGWYDYNFDEYREFT-NH2 |
| 174 | JBS-2685 | Ac-TGHVsAGWYDYNFDHYREFT-NH2 | 215 | JBS-2751 | Ac-TGLVSAGWYDYNFDHEREFT-NH2 |
| 175 | JBS-2686 | Ac-TGHVSAGWYDYNFDHYREFT-NH2 | 216 | JBS-2752 | Ac-TGLVSAGWYDYNFDHYEEFT-NH2 |
| 176 | JBS-2687 | Ac-TGHVSAaWYDYNFDHYREFT-NH2 | 217 | JBS-2753 | Ac-TGLVSAGWYDYNFDHYREET-NH2 |
| 177 | JBS-2688 | Ac-TGHVSAGWyDYNFDHYREFT-NH2 | 218 | JBS-2754 | Ac-TGLVSAGWYDYNFDHYREFE-NH2 |
| 178 | JBS-2689 | Ac-TGHVEVGWYDYNFDHYREFT-NH2 | 219 | JBS-2755 | Ac-HGLVSAGWYDYNFDHYREFT-NH2 |
| 179 | JBS-2696 | Bio-Ttds-TGHVSAGWYDYNADHYREFT-NH2 | 220 | JBS-2756 | Ac-THLVSAGWYDYNFDHYREFT-NH2 |
| 180 | JBS-2697 | Bio-Ttds-TGLVSAGWYDYNFDHYREFT-NH2 | 221 | JBS-2757 | Ac-TGLHSAGWYDYNFDHYREFT-NH2 |
| 181 | JBS-2698 | Bio-Ttds-TPHVSAGWYDYNFDHYREFT-NH2 | 222 | JBS-2758 | Ac-TGLVHAGWYDYNFDHYREFT-NH2 |
| 182 | JBS-2699 | Bio-Ttds-TGHVSAGWYDYNFDHYREF-NH2 | 223 | JBS-2759 | Ac-TGLVSHGWYDYNFDHYREFT-NH2 |
| 183 | JBS-2713 | Ac-TGLVSAGWYDYNFDHYREFTC(ME-400MA)-NH2 | 224 | JBS-2760 | Ac-TGLVSAHWYDYNFDHYREFT-NH2 |
| 184 | JBS-2714 | Ac-C(ME-400MA)-TGLVSAGWYDYNFDHYREFT-NH2 | 225 | JBS-2761 | Ac-TGLVSAGHYDYNFDHYREFT-NH2 |
| 185 | JBS-2721 | Ac-TGL-Tle-SAGWYDYNFDHYREFT-NH2 | 226 | JBS-2762 | Ac-TGLVSAGWHDYNFDHYREFT-NH2 |
| 186 | JBS-2722 | Ac-TGLV-Dap-AGWYDYNFDHYREFT-NH2 | 227 | JBS-2763 | Ac-TGLVSAGWYHYNFDHYREFT-NH2 |
| 187 | JBS-2723 | Ac-TGLVSAG-Aib-YDYNFDHYREFT-NH2 | 228 | JBS-2764 | Ac-TGLVSAGWYDHNFDHYREFT-NH2 |
| 188 | JBS-2724 | Ac-TGLVS-Tle-GWYDYNFDHYREFT-NH2 | 229 | JBS-2765 | Ac-TGLVSAGWYDYHFDHYREFT-NH2 |
| 189 | JBS-2725 | Ac-TGLVSA-Aib-WYDYNFDHYREFT-NH2 | 230 | JBS-2766 | Ac-TGLVSAGWYDYNHDHYREFT-NH2 |
| 190 | JBS-2726 | Ac-TGLVSA-Nmg-WYDYNFDHYREFT-NH2 | 231 | JBS-2767 | Ac-TGLVSAGWYDYNFHHYREFT-NH2 |
| 191 | JBS-2727 | Ac-TGLVSAG-Bta-YDYNFDHYREFT-NH2 | 232 | JBS-2768 | Ac-TGLVSAGWYDYNFDHHREFT-NH2 |
| 192 | JBS-2728 | Ac-TGLVSAG-1Ni-YDYNFDHYREFT-NH2 | 233 | JBS-2769 | Ac-TGLVSAGWYDYNFDHYHEFT-NH2 |
| 193 | JBS-2729 | Ac-TGLVSAGWyDYNFDHYREFT-NH2 | 234 | JBS-2770 | Ac-TGLVSAGWYDYNFDHYRHFT-NH2 |
| 194 | JBS-2730 | Ac-TGLVSAGWYDYNaDHYREFT-NH2 | 235 | JBS-2771 | Ac-TGLVSAGWYDYNFDHYRHEFT-NH2 |
| 195 | JBS-2731 | Ac-TGLVSAGWYDYNFDHYREFT-NH2 | 236 | JBS-2772 | Ac-TGLVSAGWYDYNFDHYREHT-NH2 |
| 196 | JBS-2732 | Ac-TGLVSAGWYDYNFDHYREFT-NH2 | 237 | JBS-2773 | Ac-TGLVSAGWYDYNFDHYREFH-NH2 |
| 197 | JBS-2733 | Ac-TGLVSAGWYDYnFDHYREFT-NH2 | 238 | JBS-2774 | Ac-IGLVSAGWYDYNFDHYREFT-NH2 |
| 198 | JBS-2734 | Ac-TGLVSAGWYDYNaDHYREFT-NH2 | 239 | JBS-2775 | Ac-TILVSAGWYDYNFDHYREFT-NH2 |

FIGURE 2C

| SEQ ID | Compound | Sequence | SEQ ID | Compound | Sequence |
|---|---|---|---|---|---|
| 240 | JBS-2776 | Ac-TGLVSAGWYDYNFDHYREFT-NH2 | 281 | JBS-2817 | Ac-TGLNSAGWYDYNFDHYREFT-NH2 |
| 241 | JBS-2777 | Ac-TGLISAGWYDYNFDHYREFT-NH2 | 282 | JBS-2818 | Ac-TGLVNAGWYDYNFDHYREFT-NH2 |
| 242 | JBS-2778 | Ac-TGLVIAGWYDYNFDHYREFT-NH2 | 283 | JBS-2819 | Ac-TGLVSNGWYDYNFDHYREFT-NH2 |
| 243 | JBS-2779 | Ac-TGLVSIGWYDYNFDHYREFT-NH2 | 284 | JBS-2820 | Ac-TGLVSANWYDYNFDHYREFT-NH2 |
| 244 | JBS-2780 | Ac-TGLVSAIWYDYNFDHYREFT-NH2 | 285 | JBS-2821 | Ac-TGLVSAGNYDYNFDHYREFT-NH2 |
| 245 | JBS-2781 | Ac-TGLVSAGIYDYNFDHYREFT-NH2 | 286 | JBS-2822 | Ac-TGLVSAGWNDYNFDHYREFT-NH2 |
| 246 | JBS-2782 | Ac-TGLVSAGWIDYNFDHYREFT-NH2 | 287 | JBS-2823 | Ac-TGLVSAGWYNYNFDHYREFT-NH2 |
| 247 | JBS-2783 | Ac-TGLVSAGWYIDINFDHYREFT-NH2 | 288 | JBS-2824 | Ac-TGLVSAGWYDNNFDHYREFT-NH2 |
| 248 | JBS-2784 | Ac-TGLVSAGWYDINFDHYREFT-NH2 | 289 | JBS-2825 | Ac-TGLVSAGWYDYNNDHYREFT-NH2 |
| 249 | JBS-2785 | Ac-TGLVSAGWYDYIFDHYREFT-NH2 | 290 | JBS-2826 | Ac-TGLVSAGWYDYNFNHYREFT-NH2 |
| 250 | JBS-2786 | Ac-TGLVSAGWYDYNIDHYREFT-NH2 | 291 | JBS-2827 | Ac-TGLVSAGWYDYNFDNYREFT-NH2 |
| 251 | JBS-2787 | Ac-TGLVSAGWYDYNFIHYREFT-NH2 | 292 | JBS-2828 | Ac-TGLVSAGWYDYNFDHNREFT-NH2 |
| 252 | JBS-2788 | Ac-TGLVSAGWYDYNFDIYREFT-NH2 | 293 | JBS-2829 | Ac-TGLVSAGWYDYNFDHYNEFT-NH2 |
| 253 | JBS-2789 | Ac-TGLVSAGWYDYNFDHIREFT-NH2 | 294 | JBS-2830 | Ac-TGLVSAGWYDYNFDHYRNFT-NH2 |
| 254 | JBS-2790 | Ac-TGLVSAGWYDYNFDHYIEFT-NH2 | 295 | JBS-2831 | Ac-TGLVSAGWYDYNFDHYRENT-NH2 |
| 255 | JBS-2791 | Ac-TGLVSAGWYDYNFDHYRIFT-NH2 | 296 | JBS-2832 | Ac-TGLVSAGWYDYNFDHYREFN-NH2 |
| 256 | JBS-2792 | Ac-TGLVSAGWYDYNFDHYREIT-NH2 | 297 | JBS-2833 | Ac-QGLVSAGWYDYNFDHYREFT-NH2 |
| 257 | JBS-2793 | Ac-TGLVSMGWYDYNFDHYREFI-NH2 | 298 | JBS-2834 | Ac-TQLVSAGWYDYNFDHYREFT-NH2 |
| 258 | JBS-2794 | Ac-MGLVSAGWYDYNFDHYREFT-NH2 | 299 | JBS-2835 | Ac-TGQVSAGWYDYNFDHYREFT-NH2 |
| 259 | JBS-2795 | Ac-TMLVSAGWYDYNFDHYREFT-NH2 | 300 | JBS-2836 | Ac-TGLQSAGWYDYNFDHYREFT-NH2 |
| 260 | JBS-2796 | Ac-TGMVSAGWYDYNFDHYREFT-NH2 | 301 | JBS-2837 | Ac-TGLVQAGWYDYNFDHYREFT-NH2 |
| 261 | JBS-2797 | Ac-TGLMSAGWYDYNFDHYREFT-NH2 | 302 | JBS-2838 | Ac-TGLVSQGWYDYNFDHYREFT-NH2 |
| 262 | JBS-2798 | Ac-TGLVMAGWYDYNFDHYREFT-NH2 | 303 | JBS-2839 | Ac-TGLVSAQWYDYNFDHYREFT-NH2 |
| 263 | JBS-2799 | Ac-TGLVSMGWYDYNFDHYREFT-NH2 | 304 | JBS-2840 | Ac-TGLVSAGQYDYNFDHYREFT-NH2 |
| 264 | JBS-2800 | Ac-TGLVSAMWYDYNFDHYREFT-NH2 | 305 | JBS-2841 | Ac-TGLVSAGWQDYNFDHYREFT-NH2 |
| 265 | JBS-2801 | Ac-TGLVSAGMYDYNFDHYREFT-NH2 | 306 | JBS-2842 | Ac-TGLVSAGWYQYNFDHYREFT-NH2 |
| 266 | JBS-2802 | Ac-TGLVSAGWMDYNFDHYREFT-NH2 | 307 | JBS-2843 | Ac-TGLVSAGWYDQNFDHYREFT-NH2 |
| 267 | JBS-2803 | Ac-TGLVSAGWYMYNFDHYREFT-NH2 | 308 | JBS-2844 | Ac-TGLVSAGWYDYQFDHYREFT-NH2 |
| 268 | JBS-2804 | Ac-TGLVSAGWYDMNFDHYREFT-NH2 | 309 | JBS-2845 | Ac-TGLVSAGWYDYNQDHYREFT-NH2 |
| 269 | JBS-2805 | Ac-TGLVSAGWYDYMFDHYREFT-NH2 | 310 | JBS-2846 | Ac-TGLVSAGWYDYNFQHYREFT-NH2 |
| 270 | JBS-2806 | Ac-TGLVSAGWYDYNMDHYREFT-NH2 | 311 | JBS-2847 | Ac-TGLVSAGWYDYNFDQYREFT-NH2 |
| 271 | JBS-2807 | Ac-TGLVSAGWYDYNFMHYREFT-NH2 | 312 | JBS-2848 | Ac-TGLVSAGWYDYNFDHQREFT-NH2 |
| 272 | JBS-2808 | Ac-TGLVSAGWYDYNFDMYREFT-NH2 | 313 | JBS-2849 | Ac-TGLVSAGWYDYNFDHYQEFT-NH2 |
| 273 | JBS-2809 | Ac-TGLVSAGWYDYNFDHMREFT-NH2 | 314 | JBS-2850 | Ac-TGLVSAGWYDYNFDHYRQFT-NH2 |
| 274 | JBS-2810 | Ac-TGLVSAGWYDYNFDHYMFT-NH2 | 315 | JBS-2851 | Ac-TGLVSAGWYDYNFDHYREQT-NH2 |
| 275 | JBS-2811 | Ac-TGLVSAGWYDYNFDHYRMFT-NH2 | 316 | JBS-2852 | Ac-TGLVSAGWYDYNFDHYREFQ-NH2 |
| 276 | JBS-2812 | Ac-TGLVSAGWYDYNFDHYREMT-NH2 | 317 | JBS-2853 | Ac-TGLVSAGWYDYNFDHYREFT-NH2 |
| 277 | JBS-2813 | Ac-TGLVSAGWYDYNFDHYREFM-NH2 | 318 | JBS-2854 | Ac-RGLVSAGWYDYNFDHYREFT-NH2 |
| 278 | JBS-2814 | Ac-NGLVSAGWYDYNFDHYREFT-NH2 | 319 | JBS-2855 | Ac-TRLVSAGWYDYNFDHYREFT-NH2 |
| 279 | JBS-2815 | Ac-TNLVSAGWYDYNFDHYREFT-NH2 | 320 | JBS-2856 | Ac-TGRVSAGWYDYNFDHYREFT-NH2 |
| 280 | JBS-2816 | Ac-TGNVSAGWYDYNFDHYREFT-NH2 | 321 | JBS-2857 | Ac-TGLRSAGWYDYNFDHYREFT-NH2 |

FIGURE 2D

| SEQ ID | Compound | Sequence | SEQ ID | Compound | Sequence |
|---|---|---|---|---|---|
| 322 | JBS-2858 | Ac-TGLVSRGWYDYNFDHYREFT-NH2 | 363 | JBS-2899 | Ac-TGLVSAGWYDYNFDHYREFT-NH2 |
| 323 | JBS-2859 | Ac-TGLVSARWYDYNFDHYREFT-NH2 | 364 | JBS-2900 | Ac-TGLVSAGWYDYVFDHYREFT-NH2 |
| 324 | JBS-2860 | Ac-TGLVSAGRYDYNFDHYREFT-NH2 | 365 | JBS-2901 | Ac-TGLVSAGWYDYNVDHYREFT-NH2 |
| 325 | JBS-2861 | Ac-TGLVSAGWRDYNFDHYREFT-NH2 | 366 | JBS-2902 | Ac-TGLVSAGWYDYNFVHYREFT-NH2 |
| 326 | JBS-2862 | Ac-TGLVSAGWYRYNFDHYREFT-NH2 | 367 | JBS-2903 | Ac-TGLVSAGWYDYNFDVYREFT-NH2 |
| 327 | JBS-2863 | Ac-TGLVSAGWYDRNFDHYREFT-NH2 | 368 | JBS-2904 | Ac-TGLVSAGWYDYNFDHVREFT-NH2 |
| 328 | JBS-2864 | Ac-TGLVSAGWYDYRFDHYREFT-NH2 | 369 | JBS-2905 | Ac-TGLVSAGWYDYNFDHYVEFT-NH2 |
| 329 | JBS-2865 | Ac-TGLVSAGWYDYNRDHYREFT-NH2 | 370 | JBS-2906 | Ac-TGLVSAGWYDYNFDHYRVFT-NH2 |
| 330 | JBS-2866 | Ac-TGLVSAGWYDYNFRHYREFT-NH2 | 371 | JBS-2907 | Ac-TGLVSAGWYDYNFDHYREVT-NH2 |
| 331 | JBS-2867 | Ac-TGLVSAGWYDYNFDRYREFT-NH2 | 372 | JBS-2908 | Ac-TGLVSAGWYDYNFDHYREFV-NH2 |
| 332 | JBS-2868 | Ac-TGLVSAGWYDYNFDHRREFT-NH2 | 373 | JBS-2909 | Ac-WGLVSAGWYDYNFDHYREFT-NH2 |
| 333 | JBS-2869 | Ac-TGLVSAGWYDYNFDHYRRFT-NH2 | 374 | JBS-2910 | Ac-TWLVSAGWYDYNFDHYREFT-NH2 |
| 334 | JBS-2870 | Ac-TGLVSAGWYDYNFDHYRERT-NH2 | 375 | JBS-2911 | Ac-TGWVSAGWYDYNFDHYREFT-NH2 |
| 335 | JBS-2871 | Ac-TGLVSAGWYDYNFDHYREFR-NH2 | 376 | JBS-2912 | Ac-TGLWSAGWYDYNFDHYREFT-NH2 |
| 336 | JBS-2872 | Ac-TTLVSAGWYDYNFDHYREFT-NH2 | 377 | JBS-2913 | Ac-TGLVWAGWYDYNFDHYREFT-NH2 |
| 337 | JBS-2873 | Ac-TGTVSAGWYDYNFDHYREFT-NH2 | 378 | JBS-2914 | Ac-TGLVSWGWYDYNFDHYREFT-NH2 |
| 338 | JBS-2874 | Ac-TGLTSAGWYDYNFDHYREFT-NH2 | 379 | JBS-2915 | Ac-TGLVSAWWYDYNFDWYREFT-NH2 |
| 339 | JBS-2875 | Ac-TGLVTAGWYDYNFDHYREFT-NH2 | 380 | JBS-2916 | Ac-TGLVSAGWWDYNFDHYREFT-NH2 |
| 340 | JBS-2876 | Ac-TGLVSTGWYDYNFDHYREFT-NH2 | 381 | JBS-2917 | Ac-TGLVSAGWYWYNFDHYREFT-NH2 |
| 341 | JBS-2877 | Ac-TGLVSATWYDYNFDHYREFT-NH2 | 382 | JBS-2918 | Ac-TGLVSAGWYDWNFDHYREFT-NH2 |
| 342 | JBS-2878 | Ac-TGLVSAGTYDYNFDHYREFT-NH2 | 383 | JBS-2919 | Ac-TGLVSAGWYDYWFDHYREFT-NH2 |
| 343 | JBS-2879 | Ac-TGLVSAGWTDYNFDHYREFT-NH2 | 384 | JBS-2920 | Ac-TGLVSAGWYDYNWDHYREFT-NH2 |
| 344 | JBS-2880 | Ac-TGLVSAGWYTYNFDHYREFT-NH2 | 385 | JBS-2921 | Ac-TGLVSAGWYDYNFWHYREFT-NH2 |
| 345 | JBS-2881 | Ac-TGLVSAGWYDTNFDHYREFT-NH2 | 386 | JBS-2922 | Ac-TGLVSAGWYDYNFDWYREFT-NH2 |
| 346 | JBS-2882 | Ac-TGLVSAGWYDYTFDHYREFT-NH2 | 387 | JBS-2923 | Ac-TGLVSAGWYDYNFDHWREFT-NH2 |
| 347 | JBS-2883 | Ac-TGLVSAGWYDYNTDHYREFT-NH2 | 388 | JBS-2924 | Ac-TGLVSAGWYDYNFDHYWEFT-NH2 |
| 348 | JBS-2884 | Ac-TGLVSAGWYDYNFTHYREFT-NH2 | 389 | JBS-2925 | Ac-TGLVSAGWYDYNFDHYRWFT-NH2 |
| 349 | JBS-2885 | Ac-TGLVSAGWYDYNFDTYREFT-NH2 | 390 | JBS-2926 | Ac-TGLVSAGWYDYNFDHYREWT-NH2 |
| 350 | JBS-2886 | Ac-TGLVSAGWYDYNFDHTREFT-NH2 | 391 | JBS-2927 | Ac-TGLVSAGWYDYNFDHYREFW-NH2 |
| 351 | JBS-2887 | Ac-TGLVSAGWYDYNFDHYTEFT-NH2 | 392 | JBS-2928 | Ac-YGLVSAGWYDYNFDHYREFT-NH2 |
| 352 | JBS-2888 | Ac-TGLVSAGWYDYNFDHYRTFT-NH2 | 393 | JBS-2929 | Ac-TYLVSAGWYDYNFDHYREFT-NH2 |
| 353 | JBS-2889 | Ac-TGLVSAGWYDYNFDHYRETT-NH2 | 394 | JBS-2930 | Ac-TGYVSAGWYDYNFDHYREFT-NH2 |
| 354 | JBS-2890 | Ac-VGLVSAGWYDYNFDHYREFT-NH2 | 395 | JBS-2931 | Ac-TGLYSAGWYDYNFDHYREFT-NH2 |
| 355 | JBS-2891 | Ac-TVLVSAGWYDYNFDHYREFT-NH2 | 396 | JBS-2932 | Ac-TGLVYAGWYDYNFDHYREFT-NH2 |
| 356 | JBS-2892 | Ac-TGVVSAGWYDYNFDHYREFT-NH2 | 397 | JBS-2933 | Ac-TGLVSYGWYDYNFDHYREFT-NH2 |
| 357 | JBS-2893 | Ac-TGLVSAGYYDYNFDHYREFT-NH2 | 398 | JBS-2934 | Ac-TGLVSAYWYDYNFDHYREFT-NH2 |
| 358 | JBS-2894 | Ac-TGLVSAGWYYDYNFDHYREFT-NH2 | 399 | JBS-2935 | Ac-TGLVSAGYYDYNFDHYREFT-NH2 |
| 359 | JBS-2895 | Ac-TGLVSVGWYDYNFDHYREFT-NH2 | 400 | JBS-2936 | Ac-TGLVSAGWYYYNFDHYREFT-NH2 |
| 360 | JBS-2896 | Ac-TGLVSAVWYDYNFDHYREFT-NH2 | 401 | JBS-2937 | Ac-TGLVSAGWYDYYFDHYREFT-NH2 |
| 361 | JBS-2897 | Ac-TGLVSAGWVYDYNFDHYREFT-NH2 | 402 | JBS-2938 | Ac-TGLVSAGWYDYNYDHYREFT-NH2 |
| 362 | JBS-2898 | Ac-TGLVSAGWVYYNFDHYREFT-NH2 | 403 | JBS-2939 | Ac-TGLVSAGWYDYNFYHYREFT-NH2 |

FIGURE 2E

| SEQ ID | Compound | Sequence | SEQ ID | Compound | Sequence |
|---|---|---|---|---|---|
| 404 | JBS-2940 | Ac-TGLVSAGWYDYNFDYHYREFT-NH2 | 445 | JBS-3193 | Ac-TGLVEAGWYDYNFDVYREFT-NH2 |
| 405 | JBS-2941 | Ac-TGLVSAGWYDYNFDHYREFT-NH2 | 446 | JBS-3194 | Ac-TGLVSAGWYDYNNDTYREFT-NH2 |
| 406 | JBS-2942 | Ac-TGLVSAGWYDYNFDHYRFYT-NH2 | 447 | JBS-3195 | Ac-TGLVSAGWYDYNNDVYREFT-NH2 |
| 407 | JBS-2943 | Ac-TGLVSAGWYDYNFDHYREFY-NH2 | 448 | JBS-3196 | Ac-YGLVSAGWYDYNFDHYMEFT-NH2 |
| 408 | JBS-2944 | Ac-TGLVSAGWYDYNFDHYREFTC(NEM)-NH2 | 449 | JBS-3197 | Ac-TGLVEAGWYDYNFDHYMEFT-NH2 |
| 409 | JBS-3152 | Ac-TGLVSAGWYDYNFDHYREFTC(NEM)-NH2 | 450 | JBS-3198 | Ac-TGLVSAGWYDYNNDHYMEFT-NH2 |
| 410 | JBS-3153 | Ac-C(NEM)-TGLVSAGWYDYNFDHYREFT-NH2 | 451 | JBS-3199 | Ac-TGLVSAGWYDYNFD-Tle-YREFT-NH2 |
| 411 | JBS-3156 | Ac-[CGLVSAGWYC]DYNFDHYREFT-NH2 | 452 | JBS-3200 | Ac-TGLVSAGWYDYNFDHY-Nle-EFT-NH2 |
| 412 | JBS-3157 | Ac-[CGLVSAGWYDC]YNFDHYREFT-NH2 | 453 | JBS-3201 | Ac-YGLVSAGWYDYNNDTYMEFT-NH2 |
| 413 | JBS-3158 | Ac-[CGLVSAGWYDYC]NFDHYREFT-NH2 | 454 | JBS-3202 | Ac-TGL-Tle-SAGWYDYNFDTYREFT-NH2 |
| 414 | JBS-3159 | Ac-[CGLVSAGWYDYNC]FDHYREFT-NH2 | 455 | JBS-3203 | Ac-TGL-Tle-SAGWYDYNFDHYMEFT-NH2 |
| 415 | JBS-3160 | Ac-[CGLVSAGWYDYNFC]DHYREFT-NH2 | 456 | JBS-3204 | Ac-TGL-Tle-SAGWYDYNFDTYMEFT-NH2 |
| 416 | JBS-3161 | Ac-T[CLVSAGWYC]DYNFDHYREFT-NH2 | 457 | JBS-3205 | Ac-TGLVSAGWYDYNFDHYREFT-Bpa--NH2 |
| 417 | JBS-3162 | Ac-T[CLVSAGWYDC]YNFDHYREFT-NH2 | 458 | JBS-3206 | Ac-TGLVSAGWYDYNFDHYREFTC-NH2 |
| 418 | JBS-3163 | Ac-T[CLVSAGWYDYC]NFDHYREFT-NH2 | 459 | JBS-3207 | Ac-CTGLVSAGWYDYNFDHYREFT-NH2 |
| 419 | JBS-3164 | Ac-T[CLVSAGWYDYNC]FDHYREFT-NH2 | 460 | JBS-3208 | Ac-Bpa-TGLVSAGWYDYNFDHYREFT-NH2 |
| 420 | JBS-3165 | Ac-T[CLVSAGWYDYNFC]DHYREFT-NH2 | 461 | JBS-3215 | Ac-MEYVSAGWYDYNTDTYYEFE-NH2 |
| 421 | JBS-3166 | Ac-TGLV[CAGWYDYNC]DHYREFT-NH2 | 462 | JBS-3216 | Ac-EYYVSAGWYDYNTDTYYEFE-NH2 |
| 422 | JBS-3167 | Ac-TGLV[CSAGWYDYNC]FDHYREFT-NH2 | 463 | JBS-3217 | Ac-EYYVSAGWYDYNNDKYYEFE-NH2 |
| 423 | JBS-3168 | Ac-TGL[CSAGWYDYNC]DHYREFT-NH2 | 464 | JBS-3218 | Ac-EYYVSAGWYDYNNDIYYEFE-NH2 |
| 424 | JBS-3169 | Ac-TG[CLVSAGWYDYNC]DHYREFT-NH2 | 465 | JBS-3219 | Ac-EYYVSAGWYDYNKDTYEEEK-NH2 |
| 425 | JBS-3170 | Ac-[CGLVSAGWYDYNC]DHYREFT-NH2 | 466 | JBS-3220 | Ac-EYYVSAGWYDYNTDTYYEFY-NH2 |
| 426 | JBS-3171 | Ac-T[CLVSAGWYDYNC]DHYREFT-NH2 | 467 | JBS-3221 | Ac-YGLVSAGWYDYNTDTYYEFY-NH2 |
| 427 | JBS-3172 | Ac-T[CLVSAGWYDYNFDC]YREFT-NH2 | 468 | JBS-3222 | Ac-EGYVSAGWYDYNTDTYYEFE-NH2 |
| 428 | JBS-3173 | Ac-T[CLVSAGWYDYNFDC]YREFT-NH2 | 469 | JBS-3223 | Ac-ESYVSAGWYDYNTDTYYEFE-NH2 |
| 429 | JBS-3175 | Ac-CGLVSAGWYDYNFDCYREFT-NH2 | 470 | JBS-3224 | H-MEYVSAGWYDYNTDTYYEFE-NH2 |
| 430 | JBS-3176 | Ac-CCGLVSAGWYDYNFDCYREFT-NH2 | 471 | JBS-3225 | Ac-TGLVSAGWYDYNFDHYREFTC(Atf-Bio)-NH2 |
| 431 | JBS-3177 | Ac-TGLVSAGWYDYNCDHYREFT-NH2 | 472 | JBS-3226 | Ac-TGLVSAGWYDYNFDHYREFTC(Atf-LC-Bio)-NH2 |
| 432 | JBS-3178 | Ac-CGLVSAGWYDCYNFDHYREFT-NH2 | 473 | JBS-3227 | Ac-C(Atf-Bio)-TGLVSAGWYDYNFDHYREFT-NH2 |
| 433 | JBS-3179 | (Ac-TGLVSAGWYDYNFDHYREFTC-NH2)4-M4PEG4 | 474 | JBS-3228 | Ac-C(Atf-LC-Bio)-TGLVSAGWYDYNFDHYREFT-NH2 |
| 434 | JBS-3180 | Ac-GLVSAGWYDYNFDHYREF-NH2 | 475 | JBS-3229 | Ac-TGLVSAGWYDYNFDHYREFT-Bpa-K(Bio)-NH2 |
| 435 | JBS-3181 | Ac-GLVSAGWYDYNFDHYREF-NH2 | 476 | JBS-3230 | H-Bpa-TGLVSAGWYDYNFDHYREFT-NH2 |
| 436 | JBS-3182 | Ac-SGLVSAGWYDYNFDSYREFT-NH2 | 477 | JBS-3231 | Ac-EYYVSAGWYDYNTDTYYEFD-NH2 |
| 437 | JBS-3185 | Ac-YGLVSAGWYDYNFDVYTEFT-NH2 | 478 | JBS-3232 | Ac-EYYVTAGWYDYNTDTYYEFE-NH2 |
| 438 | JBS-3186 | Ac-YGLVSAGWYDYNFDTYREFT-NH2 | 479 | JBS-3233 | Ac-EYYVSAGWYDYNNDTYYEFE-NH2 |
| 439 | JBS-3187 | Ac-TGLVEAGWYDYNFDVIMEFT-NH2 | 480 | JBS-3234 | Ac-EYYVSAGWYDYNADTYYEFE-NH2 |
| 440 | JBS-3188 | Ac-TGLVSAGWYDYNFDVIYEFT-NH2 | 471 | JBS-3225 | Ac-TGLVSAGWYDYNFDHYREFTC(Atf-Bio)-NH2 |
| 441 | JBS-3189 | Ac-TGLVSAGWYDYNFDVYTEFT-NH2 | 472 | JBS-3226 | Ac-TGLVSAGWYDYNFDHYREFTC(Atf-LC-Bio)-NH2 |
| 442 | JBS-3190 | Ac-YGLVSAGWYDYNFDTYREFT-NH2 | 473 | JBS-3227 | Ac-C(Atf-Bio)-TGLVSAGWYDYNFDHYREFT-NH2 |
| 443 | JBS-3191 | Ac-YGLVSAGWYDYNFDTYREFT-NH2 | 474 | JBS-3228 | Ac-C(Atf-LC-Bio)-TGLVSAGWYDYNFDHYREFT-NH2 |
| 444 | JBS-3192 | Ac-TGLVEAGWYDYNFDTYREFT-NH2 | 475 | JBS-3229 | Ac-TGLVSAGWYDYNFDHYREFT-Bpa-K(Bio)-NH2 |

FIGURE 2F

| SEQ ID | Compound | Sequence |
|---|---|---|
| 476 | JBS-3230 | H--Bpa-TGLVSAGWYDYNFDHYREFT-NH2 |
| 477 | JBS-3231 | Ac-EYYVSAGWYDYNTDTYYEFD-NH2 |
| 478 | JBS-3232 | Ac-EYYVTAGWYDYNTDTYYEFE-NH2 |
| 479 | JBS-3233 | Ac-EYYVSAGWYDYNNDTYYEFE-NH2 |
| 480 | JBS-3234 | Ac-EYYVSAGWYDYNADTYYEFE-NH2 |
| 481 | JBS-3235 | Ac-EYYVSAGWYDYMTDTYEFE-NH2 |
| 482 | JBS-3236 | Ac-EYYVEAGWYEYNTDNYYPFE-NH2 |
| 483 | JBS-3237 | Ac-EYYVSAGWYDYNTDKYYEFI-NH2 |
| 484 | JBS-3238 | Ac-EYYVSAGWYDYNTDRYYEFY-NH2 |
| 485 | JBS-3239 | Ac-EYYVSAGWYDTNNDRYYEFI-NH2 |
| 486 | JBS-3240 | Ac-EYYVSAGWYDYNNDIYYEFY-NH2 |
| 487 | JBS-3241 | Ac-EYYVSAGWYDYNNDIYLEFE-NH2 |
| 488 | JBS-3242 | Ac-EYYVSAGWHDYNKDIYFEFF-NH2 |
| 489 | JBS-3243 | Ac-EYYVSAGWYDYNNDTYNEFW-NH2 |
| 490 | JBS-3244 | Ac-EYYVSAGWYDYNSDITYEFI-NH2 |
| 491 | JBS-3245 | Ac-EYYVSAGWYDYNSDTYFEFI-NH2 |
| 492 | JBS-3246 | Ac-EYYVSAGWYDYEHDTYLEFY-NH2 |
| 493 | JBS-3247 | Ac-EYYVSAGWYNYEEDSYYEFE-NH2 |
| 494 | JBS-3248 | Ac-EYYVSAGWYDYNDVYTEFE-NH2 |
| 495 | JBS-3249 | Ac-EQYVSAGWYEYNTDTYYEFD-NH2 |
| 496 | JBS-3250 | Ac-EYYVSAGWYEYNTDTYYEFD-NH2 |
| 497 | JBS-3251 | Ac-QYYVVAGWYGYNNDRYYEFW-NH2 |
| 498 | JBS-3252 | Ac-EYYVSAGWYDMNNDTSYYEFD-NH2 |
| 499 | JBS-3253 | Ac-EYYVSAGWYDMNRDTYTEFY-NH2 |
| 500 | JBS-3254 | Ac-EYTVSAGWYNYNADEYYEFE-NH2 |
| 501 | JBS-3255 | Ac-EYTISAGWYDYNTDMYYEFY-NH2 |
| 502 | JBS-3256 | Ac-EYTASAGWYDYNSDTYYEFE-NH2 |
| 503 | JBS-3257 | Ac-YGIVEAGWYEYNTDEYIEFW-NH2 |
| 504 | JBS-3258 | Ac-YGIVSAGWYEYNTDIYYEEFW-NH2 |
| 505 | JBS-3259 | Ac-YGIVSAGWYDMNNDYFEFY-NH2 |
| 506 | JBS-3260 | Ac-EGYVSAGWYDYNKDIYLEFY-NH2 |
| 507 | JBS-3261 | Ac-EGYVSAGWYDYNQDIYFEFA-NH2 |
| 508 | JBS-3262 | Ac-ESYVSAGWYDYNIDAYYEFY-NH2 |
| 509 | JBS-3263 | Ac-ESYVSAGWYDYNTDVYYEFE-NH2 |
| 510 | JBS-3264 | Ac-EYIVTAGWYDYNKDIYYEFK-NH2 |
| 511 | JBS-3265 | Ac-EYIVEAGWYDINEDKYLEFY-NH2 |
| 512 | JBS-3266 | Ac-EYSVSAGWYDYNTDVYYEFY-NH2 |
| 513 | JBS-3267 | Ac-EYSVSAGWYDYNTDEYYEFF-NH2 |
| 514 | JBS-3268 | Ac-ESIVSAGWYDYNTDTYYEFT-NH2 |
| 515 | JBS-3269 | Ac-FGIVSAGWYDYNEDAYSEFY-NH2 |
| 516 | JBS-3270 | Ac-FGIISAGWYDYNEDAYSEFY-NH2 |
| 517 | JBS-3271 | Ac-FEYVSAGWYDYNTDTYYEFY-NH2 |
| 518 | JBS-3272 | Ac-FEYVIAGWYDYNTDTYHEFN-NH2 |
| 519 | JBS-3273 | Ac-SAIVSAGWYDYNKDVYFEFE-NH2 |
| 520 | JBS-3274 | Ac-EVIVSAGWYDYNNDIYYEFW-NH2 |
| 521 | JBS-3275 | Ac-EVIVSAGWYDYNNDTYYEFG-NH2 |
| 522 | JBS-3276 | Ac-EAMVSAGWYDYNDDKYYEFG-NH2 |
| 523 | JBS-3277 | Ac-EYEVSAGWYDYNNDVYNEFY-NH2 |
| 524 | JBS-3278 | Ac-EYFVSAGWYDYNADIYYEFD-NH2 |
| 525 | JBS-3279 | Ac-YNIVSAGWYDYNKDIYYEFF-NH2 |
| 526 | JBS-3280 | Ac-YNEVSAGWYDMNEDTYYEFY-NH2 |
| 527 | JBS-3281 | Ac-YYEVSAGWYDYNTDTYSEFW-NH2 |
| 528 | JBS-3282 | Ac-EVEVSAGWYEYNTDTYYEFW-NH2 |
| 529 | JBS-3283 | Ac-AIYVTAGWYDYNNDTYYEFT-NH2 |
| 530 | JBS-3284 | Ac-HIYVTAGWYDYNTDTYHEFE-NH2 |
| 531 | JBS-3285 | Ac-RIYVSAGWYDIIQDTYFEFY-NH2 |
| 532 | JBS-3286 | Ac-NYIVSAGWYDYNNDEYIEFY-NH2 |
| 533 | JBS-3287 | Ac-EVVVSAGWYNYNEDAYYEFW-NH2 |
| 534 | JBS-3288 | Ac-DVYVSAGWYDYNEDTYYEFS-NH2 |
| 535 | JBS-3289 | Ac-NMVVSAGWYNYNEDTYEEFY-NH2 |
| 536 | JBS-3290 | Ac-NMEVSAGWYDYNSDTYHEFW-NH2 |
| 537 | JBS-3291 | Ac-EAIVSIGWYDYNKDEYYEFY-NH2 |
| 538 | JBS-3292 | Ac-EFIVSAGWYDYNKDTYIEFE-NH2 |
| 539 | JBS-3293 | Ac-EAMVSAGWYDYMNDTYYEFE-NH2 |
| 540 | JBS-3294 | Ac-EHIVSAGWYDYNMDEYYEFW-NH2 |
| 541 | JBS-3295 | Ac-DDEVSIGWYDYNTDEYYEFW-NH2 |
| 542 | JBS-3296 | Ac-DVHVSAGWYDYNKDIYYEFT-NH2 |
| 543 | JBS-3297 | Ac-DNIVSAGWYDYNTDTYEFY-NH2 |
| 544 | JBS-3298 | Ac-VIEVSAGWYDYNEDKYYEFW-NH2 |
| 545 | JBS-3299 | Ac-VFIVSAGWYDYNDDKYYEFW-NH2 |
| 546 | JBS-3300 | Ac-KVEVSAGWYDYNKDVYYEFE-NH2 |
| 547 | JBS-3301 | Ac-KDKVSAGWYDYNSDTYYEFT-NH2 |
| 548 | JBS-3302 | Ac-IIMVSAGWYDYNTDTYYEFE-NH2 |
| 549 | JBS-3303 | Ac-ITHVTAGWYDYNTDTYYEFI-NH2 |
| 550 | JBS-3304 | Ac-VIEVSAGWYDYNEDKYYEFW-NH2 |
| 551 | JBS-3305 | Ac-VF1VSAGWYDYNDDKYYEFW-NH2 |
| 552 | JBS-3306 | Ac-AYIVEAGWYDYNTDTYEFW-NH2 |
| 553 | JBS-3307 | Ac-HWVSAGWYDYNEDKYYEFE-NH2 |
| 554 | JBS-3308 | Ac-HYNVSAGWYDYNTDTYYEFY-NH2 |
| 555 | JBS-3309 | Ac-WYEVEIGWYDYNTDTYQEFY-NH2 |
| 556 | JBS-3310 | Ac-YVTVSAGWYDYNKDEYYEFY-NH2 |
| 557 | JBS-3311 | Ac-NFIVSAGWYDYNTDTYYEFQ-NH2 |

FIGURE 2G

| SEQ ID | Compound | Sequence | SEQ ID | Compound | Sequence |
|---|---|---|---|---|---|
| 558 | JBS-3312 | Ac-EYYVSAGWYDYNTDTYYEF-NH2 | 599 | JBS-3353 | Ac-EYYVSCGWYDYNTDTYYEFE-NH2 |
| 559 | JBS-3313 | Ac-EYYVSAGWYDYNTDTYYEFN-NH2 | 600 | JBS-3354 | Ac-EYYVSACWYDYNTDTYYEFE-NH2 |
| 560 | JBS-3314 | Ac-EYYVSAGWYDYNTDTYYEFT-NH2 | 601 | JBS-3355 | Ac-EYYVSAGCYDYNTDTYYEFE-NH2 |
| 561 | JBS-3315 | Ac-TGLvSAGWYDYNFDHYREFT-C(MalCy5)-NH2 | 602 | JBS-3356 | Ac-EYYVSAGWCDYNTDTYYEFE-NH2 |
| 562 | JBS-3316 | Bio-Ttds-EYYVSAGWYDYNTDTYYEFE-NH2 | 603 | JBS-3357 | Ac-EYYVSAGWYCYNTDTYYEFE-NH2 |
| 563 | JBS-3317 | Ac-EYY-Tle-GAGWYDYNTDTYYEFE-NH2 | 604 | JBS-3358 | Ac-EYYVSAGWYDCNTDTYYEFE-NH2 |
| 564 | JBS-3318 | Ac-EYYVSAGWYDYNTDTYYEFEC(ME-400MA)-NH2 | 605 | JBS-3359 | Ac-EYYVSAGWYDYCTDTYYEFE-NH2 |
| 565 | JBS-3319 | Ac-EYYVSAGWYDYNTDTYYEFEC-NH2 | 606 | JBS-3360 | Ac-EYYVSAGWYDYNCDTYYEFE-NH2 |
| 566 | JBS-3320 | Ac-EYYVSAGWYDYNTDTYYEFE-C(NEM)--NH2 | 607 | JBS-3361 | Ac-EYYVSAGWYDYNTCTYYEFE-NH2 |
| 567 | JBS-3321 | (Ac-EYYVSAGWYDYNTDTYYEFE-NH2)4-M4PEG1 | 608 | JBS-3362 | Ac-EYYVSAGWYDYNTDCYYEFE-NH2 |
| 568 | JBS-3322 | Ac-EYYVTAGWYDYNKDIYYEFC(ME-400MA)-NH2 | 609 | JBS-3363 | Ac-EYYVSAGWYDYNTDTCYEFE-NH2 |
| 569 | JBS-3323 | Ac-YAEYGYSVWDEEYNYTYFD-NH2 | 610 | JBS-3364 | Ac-EYYVSAGWYDYNTDTYCEFE-NH2 |
| 570 | JBS-3324 | Ac-YWYTDEDVYEFSYNYATYEG-NH2 | 611 | JBS-3365 | Ac-EYYVSAGWYDYNTDTYYCFE-NH2 |
| 571 | JBS-3325 | Ac-EYYVSAGWYDYNTDTYYEFE-K(Ac)--NH2 | 612 | JBS-3366 | Ac-EYYVSAGWYDYNTDTYYECE-NH2 |
| 572 | JBS-3326 | Ac--Ahx-EYYVSAGWYDYNTDTYYEFE-K(Ac)--NH2 | 613 | JBS-3367 | Ac-EYYVSAGWYDCNTDTYYEFC-NH2 |
| 573 | JBS-3327 | Ac-EYYVSAGWYDYNTDTYYEFE-C(FeBABE)--NH2 | 614 | JBS-3368 | Ac-DYYVSAGWYDYNTDTYYEFE-NH2 |
| 574 | JBS-3328 | Ac-YAEYGYSVWDEEYNYTYFD-C(FeBABE)--NH2 | 615 | JBS-3369 | Ac-EDYVSAGWYDYNTDTYYEFE-NH2 |
| 575 | JBS-3329 | Ac-EYYVSAGWYDYNTDTYYEFE-K(TtdsMal)--NH2 | 616 | JBS-3370 | Ac-EYDVSAGWYDYNTDTYYEFE-NH2 |
| 576 | JBS-3330 | Ac-AYYVSAGWYDYNTDTYYEFE-NH2 | 617 | JBS-3371 | Ac-EYYDSAGWYDYNTDTYYEFE-NH2 |
| 577 | JBS-3331 | Ac-EAVVSAGWYDYNTDTYYEFE-NH2 | 618 | JBS-3372 | Ac-EYYVDAGWYDYNTDTYYEFE-NH2 |
| 578 | JBS-3332 | Ac-EYAVSAGWYDYNTDTYYEFE-NH2 | 619 | JBS-3373 | Ac-EYYVSDGWYDYNTDTYYEFE-NH2 |
| 579 | JBS-3333 | Ac-EYYASAGWYDYNTDTYYEFE-NH2 | 620 | JBS-3374 | Ac-EYYVSAGDYDYNTDTYYEFE-NH2 |
| 580 | JBS-3334 | Ac-EYYVAAGWYDYNTDTYYEFE-NH2 | 621 | JBS-3375 | Ac-EYYVSAGWDDYNTDTYYEFE-NH2 |
| 581 | JBS-3335 | Ac-EYYVSAAWYDYNTDTYYEFE-NH2 | 622 | JBS-3376 | Ac-EYYVSAGWYDDNTDTYYEFE-NH2 |
| 582 | JBS-3336 | Ac-EYYVSAGAYDYNTDTYYEFE-NH2 | 623 | JBS-3377 | Ac-EYYVSAGWYDYDTDTYYEFE-NH2 |
| 583 | JBS-3337 | Ac-EYYVSAGWADYNTDTYYEFE-NH2 | 624 | JBS-3378 | Ac-EYYVSAGWYDYNDDTYYEFE-NH2 |
| 584 | JBS-3338 | Ac-EYYVSAGWYANTDTYYEFE-NH2 | 625 | JBS-3379 | Ac-EYYVSAGWYDYNTDDYYEFE-NH2 |
| 585 | JBS-3339 | Ac-EYYVSAGWYDANTDTYYEFE-NH2 | 626 | JBS-3380 | Ac-EYYVSAGWYDYNTDTDYEFE-NH2 |
| 586 | JBS-3340 | Ac-EYYVSAGWYDAIDTYYEFE-NH2 | 627 | JBS-3381 | Ac-EYYVSAGWYDYNTDTYDEFE-NH2 |
| 587 | JBS-3341 | Ac-EYYVSAGWYDYNTATYYEFE-NH2 | 628 | JBS-3382 | Ac-EYYVSAGWYDYNTDTYYDFE-NH2 |
| 588 | JBS-3342 | Ac-EYYVSAGWYDYNTDAYYEFE-NH2 | 629 | JBS-3383 | Ac-EYYVSAGWYDYNTDTYYEDE-NH2 |
| 589 | JBS-3343 | Ac-EYYVSAGWYDYNTDTAYEFE-NH2 | 630 | JBS-3384 | Ac-EYYVSAGWYDYNTDTYYEFD-NH2 |
| 590 | JBS-3344 | Ac-EYYVSAGWYDYNTDTYABFE-NH2 | 631 | JBS-3385 | Ac-EEYVSAGWYDYNTDTYYEFE-NH2 |
| 591 | JBS-3345 | Ac-EYYVSAGWYDYNTDTYYAFE-NH2 | 632 | JBS-3386 | Ac-EYEVSAGWYDYNTDTYYEFE-NH2 |
| 592 | JBS-3346 | Ac-EYYVSAGWYDYNTDTYYEAE-NH2 | 633 | JBS-3387 | Ac-EYYESAGWYDYNTDTYYEFE-NH2 |
| 593 | JBS-3347 | Ac-EYYVSAGWYDYNTDTYYEFA-NH2 | 634 | JBS-3388 | Ac-EYYVEAGWYDYNTDTYYEFE-NH2 |
| 594 | JBS-3348 | Ac-CYYVSAGWYDYNTDTYYEFE-NH2 | 635 | JBS-3389 | Ac-EYYVSEGWYDYNTDTYYEFE-NH2 |
| 595 | JBS-3349 | Ac-ECYVSAGWYDYNTDTYYEFE-NH2 | 636 | JBS-3390 | Ac-EYYVSAEWYDYNTDTYYEFE-NH2 |
| 596 | JBS-3350 | Ac-EYCVSAGWYDYNTDTYYEFE-NH2 | 637 | JBS-3391 | Ac-EYYVSAGEYDYNTDTYYEFE-NH2 |
| 597 | JBS-3351 | Ac-EYYCSAGWYDYNTDTYYEFE-NH2 | 638 | JBS-3392 | Ac-EYYVSAGWEDYNTDTYYEFE-NH2 |
| 598 | JBS-3352 | Ac-EYYVCAGWYDYNTDTYYEFE-NH2 | 639 | JBS-3393 | Ac-EYYVSAGWYENTDTYYEFE-NH2 |

FIGURE 2H

| SEQ ID | Compound | Sequence | SEQ ID | Compound | Sequence |
|---|---|---|---|---|---|
| 640 | JBS-3394 | Ac-EYYVSAGWYDENTDTYYEFE-NH2 | 681 | JBS-3435 | Ac-EYYVSAGWYDYNTDTYYEFE-NH2 |
| 641 | JBS-3395 | Ac-EYYVSAGWYDYETDTYYEFE-NH2 | 682 | JBS-3436 | Ac-EYYVSAGWYDYNTDTYYGFE-NH2 |
| 642 | JBS-3396 | Ac-EYYVSAGWYDYNEDTYYEFE-NH2 | 683 | JBS-3437 | Ac-EYYVSAGWYDYNTDTYYGE-NH2 |
| 643 | JBS-3397 | Ac-EYYVSAGWYDYNTETYYEFE-NH2 | 684 | JBS-3438 | Ac-EYYVSAGWYDYNTDTYYEFG-NH2 |
| 644 | JBS-3398 | Ac-EYYVSAGWYDYNTDEYYEFE-NH2 | 685 | JBS-3439 | Ac-HYYVSAGWYDYNTDTYYEFE-NH2 |
| 645 | JBS-3399 | Ac-EYYVSAGWYDYNTDTEYEFE-NH2 | 686 | JBS-3440 | Ac-EHYVSAGWYDYNTDTYYEFE-NH2 |
| 646 | JBS-3400 | Ac-EYYVSAGWYDYNTDTYEEFE-NH2 | 687 | JBS-3441 | Ac-EYHVSAGWYDYNTDTYYEFE-NH2 |
| 647 | JBS-3401 | Ac-EYYVSAGWYDYNTDTYYEEE-NH2 | 688 | JBS-3442 | Ac-EYYHSAGWYDYNTDTYYEFE-NH2 |
| 648 | JBS-3402 | Ac-EYYVSAGWYDYNTDTYYEFE-NH2 | 689 | JBS-3443 | Ac-EYVHAGWYDYNTDTYYEFE-NH2 |
| 649 | JBS-3403 | Ac-EYYVSAGWYDYNTDTYYEFE-NH2 | 690 | JBS-3444 | Ac-EYYVSHGWYDYNTDTYYEFE-NH2 |
| 650 | JBS-3404 | Ac-EYFVSAGWYDYNTDTYYEFE-NH2 | 691 | JBS-3445 | Ac-EYYVSAHWYDYNTDTYYEFE-NH2 |
| 651 | JBS-3405 | Ac-EYYFSAGWYDYNTDTYYEFE-NH2 | 692 | JBS-3446 | Ac-EYYVSAGHYDYNTDTYYEFE-NH2 |
| 652 | JBS-3406 | Ac-EYYVFAGWYDYNTDTYYEFE-NH2 | 693 | JBS-3447 | Ac-EYYVSAGWHDYNTDTYYEFE-NH2 |
| 653 | JBS-3407 | Ac-EYYVSFGWYDYNTDTYYEFE-NH2 | 694 | JBS-3448 | Ac-EYYVSAGWYHYNTDTYYEFE-NH2 |
| 654 | JBS-3408 | Ac-EYYVSAFWYDYNTDTYYEFE-NH2 | 695 | JBS-3449 | Ac-EYYVSAGWYDHNTDTYYEFE-NH2 |
| 655 | JBS-3409 | Ac-EYYVSAGFYDYNTDTYYEFE-NH2 | 696 | JBS-3450 | Ac-EYYVSAGWYDYHTDTYYEFE-NH2 |
| 656 | JBS-3410 | Ac-EYYVSAGWFDYNTDTYYEFE-NH2 | 697 | JBS-3451 | Ac-EYYVSAGWYDYNHDTYYEFE-NH2 |
| 657 | JBS-3411 | Ac-EYYVSAGWYFYNTDTYYEFE-NH2 | 698 | JBS-3452 | Ac-EYYVSAGWYDYNTHTYYEFE-NH2 |
| 658 | JBS-3412 | Ac-EYYVSAGWYDFNTDTYYEFE-NH2 | 699 | JBS-3453 | Ac-EYYVSAGWYDYNTDHYYEFE-NH2 |
| 659 | JBS-3413 | Ac-EYYVSAGWYDYFTDTYYEFE-NH2 | 700 | JBS-3454 | Ac-EYYVSAGWYDYNTDTHYEFE-NH2 |
| 660 | JBS-3414 | Ac-EYYVSAGWYDYNFDTYYEFE-NH2 | 701 | JBS03455 | Ac-EYYVSAGWYDYNTDTYHFE-NH2 |
| 661 | JBS-3415 | Ac-EYYVSAGWYDYNTFTYYEFE-NH2 | 702 | JBS-3456 | Ac-EYYVSAGWYDYNTDTYYHFE-NH2 |
| 662 | JBS-3416 | Ac-EYYVSAGWYDYNTDFYYEFE-NH2 | 703 | JBS-3457 | Ac-EYYVSAGWYDYNTDTYYEHE-NH2 |
| 663 | JBS-3417 | Ac-EYYVSAGWYDYNTDTFYEFE-NH2 | 704 | JBS-3458 | Ac-EYYVSAGWYDYNTDTYYEFH-NH2 |
| 664 | JBS-3418 | Ac-EYYVSAGWYDYNTDTYFEFE-NH2 | 705 | JBS-3459 | Ac-IYYVSAGWYDYNTDTYYEFE-NH2 |
| 665 | JBS-3419 | Ac-EYYVSAGWYDYNTDTYYFFE-NH2 | 706 | JBS-3460 | Ac-EIYVSAGWYDYNTDTYYEFE-NH2 |
| 666 | JBS-3420 | Ac-EYYVSAGWYDYNTDTYYEFF-NH2 | 707 | JBS-3461 | Ac-EYIVSAGWYDYNTDTYYEFE-NH2 |
| 667 | JBS-3421 | Ac-GYYVSAGWYDYNTDTYYEFE-NH2 | 708 | JBS-3462 | Ac-EYYISAGWYDYNTDTYYEFE-NH2 |
| 668 | JBS-3422 | Ac-EYGVSAGWYDYNTDTYYEFE-NH2 | 709 | JBS-3463 | Ac-EYYVIAGWYDYNTDTYYEFE-NH2 |
| 669 | JBS-3423 | Ac-EYYGSAGWYDYNTDTYYEFE-NH2 | 710 | JBS-3464 | Ac-EYYVSIGWYDYNTDTYYEFE-NH2 |
| 670 | JBS-3424 | Ac-EYYVGAGWYDYNTDTYYEFE-NH2 | 711 | JBS-3465 | Ac-EYYVSAIWYDYNTDTYYEFE-NH2 |
| 671 | JBS-3425 | Ac-EYYVSGGWYDYNTDTYYEFE-NH2 | 712 | JBS-3466 | Ac-EYYVSAGIYDYNTDTYYEFE-NH2 |
| 672 | JBS-3426 | Ac-EYYVSAGGYDYNTDTYYEFE-NH2 | 713 | JBS-3467 | Ac-EYYVSAGWIDYNTDTYYEFE-NH2 |
| 673 | JBS-3427 | Ac-EYYVSAGWGDYNTDTYYEFE-NH2 | 714 | JBS-3468 | Ac-EYYVSAGWYIYNTDTYYEFE-NH2 |
| 674 | JBS-3428 | Ac-EYYVSAGWYGYNTDTYYEFE-NH2 | 715 | JBS-3469 | Ac-EYYVSAGWYDINTDTYYEFE-NH2 |
| 675 | JBS-3429 | Ac-EYYVSAGWYDGNTDTYYEFE-NH2 | 716 | JBS-3470 | Ac-EYYVSAGWYDYITDTYYEFE-NH2 |
| 676 | JBS-3430 | Ac-EYYVSAGWYDYGTDTYYEFE-NH2 | 717 | JBS-3471 | Ac-EYYVSAGWYDYNIDTYYEFE-NH2 |
| 677 | JBS-3431 | Ac-EYYVSAGWYDYNGDTYYEFE-NH2 | 718 | JBS-3472 | Ac-EYYVSAGWYDYNTITYYEFE-NH2 |
| 678 | JBS-3432 | Ac-EYYVSAGWYDYNTGTYYEFE-NH2 | 719 | JBS-3473 | Ac-EYYVSAGWYDYNTDIYYEFE-NH2 |
| 679 | JBS-3433 | Ac-EYYVSAGWYDYNTDGYYEFE-NH2 | 720 | JBS-3474 | Ac-EYYVSAGWYDYNTDTIYEFE-NH2 |
| 680 | JBS-3434 | Ac-EYYVSAGWYDYNTDTGYEFE-NH2 | 721 | JBS-3475 | Ac-EYYVSAGWYDYNTDTYIEFE-NH2 |

FIGURE 21

| SEQ ID | Compound | Sequence | SEQ ID | Compound | Sequence |
|---|---|---|---|---|---|
| 722 | JBS-3476 | Ac-EYYVSAGWYDYNTDTYYIFE-NH2 | 763 | JBS-3517 | Ac-EYYVSAGWYDYNTDTYYELE-NH2 |
| 723 | JBS-3477 | Ac-EYYVSAGWYDYNTDTYYEIE-NH2 | 764 | JBS-3518 | Ac-EYYVSAGWYDYNTDTYYEFL-NH2 |
| 724 | JBS-3478 | Ac-EYYVSAGWYDYNTDTYYEFI-NH2 | 765 | JBS-3519 | Ac-MYYVSAGWYDYNTDTYYEFE-NH2 |
| 725 | JBS-3479 | Ac-KYYVSAGWYDYNTDTYYEFE-NH2 | 766 | JBS-3520 | Ac-EMYVSAGWYDYNTDTYYEFE-NH2 |
| 726 | JBS-3480 | Ac-EKYVSAGWYDYNTDTYYEFE-NH2 | 767 | JBS-3521 | Ac-EYMVSAGWYDYNTDTYYEFE-NH2 |
| 727 | JBS-3481 | Ac-EYKVSAGWYDYNTDTYYEFE-NH2 | 768 | JBS-3522 | Ac-EYYMSAGWYDYNTDTYYEFE-NH2 |
| 728 | JBS-3482 | Ac-EYYKSAGWYDYNTDTYYEFE-NH2 | 769 | JBS-3523 | Ac-EYYVMAGWYDYNTDTYYEFE-NH2 |
| 729 | JBS-3483 | Ac-EYYVKAGWYDYNTDTYYEFE-NH2 | 770 | JBS-3524 | Ac-EYYVSMGWYDYNTDTYYEFE-NH2 |
| 730 | JBS-3484 | Ac-EYYVSKGWYDYNTDTYYEFE-NH2 | 771 | JBS-3525 | Ac-EYYVSAMWYDYNTDTYYEFE-NH2 |
| 731 | JBS-3485 | Ac-EYYVSAKWYDYNTDTYYEFE-NH2 | 772 | JBS-3526 | Ac-EYYVSAGMYDYNTDTYYEFE-NH2 |
| 732 | JBS-3486 | Ac-EYYVSAGKYDYNTDTYYEFE-NH2 | 773 | JBS-3527 | Ac-EYYVSAGWMDYNTDTYYEFE-NH2 |
| 733 | JBS-3487 | Ac-EYYVSAGWKDYNTDTYYEFE-NH2 | 774 | JBS-3528 | Ac-EYYVSAGWYMYNTDTYYEFE-NH2 |
| 734 | JBS-3488 | Ac-EYYVSAGWYKYNTDTYYEFE-NH2 | 775 | JBS-3529 | Ac-EYYVSAGWYDMNTDTYYEFE-NH2 |
| 735 | JBS-3489 | Ac-EYYVSAGWYDKNTDTYYEFE-NH2 | 776 | JBS-3530 | Ac-EYYVSAGWYDYMTDTYYEFE-NH2 |
| 736 | JBS-3490 | Ac-EYYVSAGWYDYKTDTYYEFE-NH2 | 777 | JBS-3531 | Ac-EYYVSAGWYDYNMDTYYEFE-NH2 |
| 737 | JBS-3491 | Ac-EYYVSAGWYDYNKDTYYEFE-NH2 | 778 | JBS-3532 | Ac-EYYVSAGWYDYNTMTYYEFE-NH2 |
| 738 | JBS-3492 | Ac-EYYVSAGWYDYNTKTYYEFE-NH2 | 779 | JBS-3533 | Ac-EYYVSAGWYDYNTDMYYEFE-NH2 |
| 739 | JBS-3493 | Ac-EYYVSAGWYDYNTDKYYEFE-NH2 | 780 | JBS-3534 | Ac-EYYVSAGWYDYNTDTMYEFE-NH2 |
| 740 | JBS-3494 | Ac-EYYVSAGWYDYNTDTKYEFE-NH2 | 781 | JBS-3535 | Ac-EYYVSAGWYDYNTDTYMEFE-NH2 |
| 741 | JBS-3495 | Ac-EYYVSAGWYDYNTDTYKEFE-NH2 | 782 | JBS-3536 | Ac-EYYVSAGWYDYNTDTYYMFE-NH2 |
| 742 | JBS-3496 | Ac-EYYVSAGWYDYNTDTYYKFE-NH2 | 783 | JBS-3537 | Ac-EYYVSAGWYDYNTDTYYEME-NH2 |
| 743 | JBS-3497 | Ac-EYYVSAGWYDYNTDTYYEKE-NH2 | 784 | JBS-3538 | Ac-EYYVSAGWYDYNTDTYYEFM-NH2 |
| 744 | JBS-3498 | Ac-EYYVSAGWYDYNTDTYYEFK-NH2 | 785 | JBS-3539 | Ac-NYYVSAGWYDYNTDTYYEFE-NH2 |
| 745 | JBS-3499 | Ac-LYYVSAGWYDYNTDTYYEFE-NH2 | 786 | JBS-3540 | Ac-ENYVSAGWYDYNTDTYYEFE-NH2 |
| 746 | JBS-3500 | Ac-ELYVSAGWYDYNTDTYYEFE-NH2 | 787 | JBS-3541 | Ac-EYNVSAGWYDYNTDTYYEFE-NH2 |
| 747 | JBS-3501 | Ac-EYLVSAGWYDYNTDTYYEFE-NH2 | 788 | JBS-3542 | Ac-EYYNSAGWYDYNTDTYYEFE-NH2 |
| 748 | JBS-3502 | Ac-EYYLSAGWYDYNTDTYYEFE-NH2 | 789 | JBS-3543 | Ac-EYYVNAGWYDYNTDTYYEFE-NH2 |
| 749 | JBS-3503 | Ac-EYYVLAGWYDYNTDTYYEFE-NH2 | 790 | JBS-3544 | Ac-EYYVSNGWYDYNTDTYYEFE-NH2 |
| 750 | JBS-3504 | Ac-EYYVSLGWYDYNTDTYYEFE-NH2 | 791 | JBS-3545 | Ac-EYYVSANWYDYNTDTYYEFE-NH2 |
| 751 | JBS-3505 | Ac-EYYVSALWYDYNTDTYYEFE-NH2 | 792 | JBS-3546 | Ac-EYYVSAGNYDYNTDTYYEFE-NH2 |
| 752 | JBS-3506 | Ac-EYYVSAGLYDYNTDTYYEFE-NH2 | 793 | JBS-3547 | Ac-EYYVSAGWNDYNTDTYYEFE-NH2 |
| 753 | JBS-3507 | Ac-EYYVSAGWLDYNTDTYYEFE-NH2 | 794 | JBS-3548 | Ac-EYYVSAGWYNYNTDTYYEFE-NH2 |
| 754 | JBS-3508 | Ac-EYYVSAGWYLYNTDTYYEFE-NH2 | 795 | JBS-3549 | Ac-EYYVSAGWYDNNTDTYYEFE-NH2 |
| 755 | JBS-3509 | Ac-EYYVSAGWYLNTDTYYEFE-NH2 | 796 | JBS-3550 | Ac-EYYVSAGWYDYNNTDTYYEFE-NH2 |
| 756 | JBS-3510 | Ac-EYYVSAGWYDLTDTYYEFE-NH2 | 797 | JBS-3551 | Ac-EYYVSAGWYDYNTDNYYEFE-NH2 |
| 757 | JBS-3511 | Ac-EYYVSAGWYDYLDTYYEFE-NH2 | 798 | JBS-3552 | Ac-EYYVSAGWYDYNTDTNYEFE-NH2 |
| 758 | JBS-3512 | Ac-EYYVSAGWYDYNLTYYEFE-NH2 | 799 | JBS-3553 | Ac-EYYVSAGWYDYNTDTYNEFE-NH2 |
| 759 | JBS-3513 | Ac-EYYVSAGWYDYNTLYYEFE-NH2 | 800 | JBS-3554 | Ac-EYYVSAGWYDYNTDTYYNFE-NH2 |
| 760 | JBS-3514 | Ac-EYYVSAGWYDYNTDLYEFE-NH2 | 801 | JBS-3555 | Ac-EYYVSAGWYDYNTDTYYENE-NH2 |
| 761 | JBS-3515 | Ac-EYYVSAGWYDYNTDTLEFE-NH2 | 802 | JBS-3556 | Ac-PYYVSAGWYDYNTDTYYEFE-NH2 |
| 762 | JBS-3516 | Ac-EYYVSAGWYDYNTDTYLFE-NH2 | 803 | JBS-3557 | Ac-EPYVSAGWYDYNTDTYYEFE-NH2 |

FIGURE 2J

| SEQ ID | Compound | Sequence | SEQ ID | Compound | Sequence |
|---|---|---|---|---|---|
| 804 | JBS-3558 | Ac-EYYVSAGWYDYNTDTYYEFE-NH2 | 845 | JBS-3599 | Ac-EYRSAGWYDYNTDTYYEFE-NH2 |
| 805 | JBS-3559 | Ac-EYPSAGWYDYNTDTYYEFE-NH2 | 846 | JBS-3600 | Ac-EYYVRAGWYDYNTDTYYEFE-NH2 |
| 806 | JBS-3560 | Ac-EYYVPAGWYDYNTDTYYEFE-NH2 | 847 | JBS-3601 | Ac-EYYVSRGWYDYNTDTYYEFE-NH2 |
| 807 | JBS-3561 | Ac-EYYVSPGWYDYNTDTYYEFE-NH2 | 848 | JBS-3602 | Ac-EYYVSARWYDYNTDTYYEFE-NH2 |
| 808 | JBS-3562 | Ac-EYYVSAPWYDYNTDTYYEFE-NH2 | 849 | JBS-3603 | Ac-EYYVSAGRYDYNTDTYYEFE-NH2 |
| 809 | JBS-3563 | Ac-EYYVSAGPYDYNTDTYYEFE-NH2 | 850 | JBS-3604 | Ac-EYYVSAGWRDYNTDTYYEFE-NH2 |
| 810 | JBS-3564 | Ac-EYYVSAGWPDYNTDTYYEFE-NH2 | 851 | JBS-3605 | Ac-EYYVSAGWYRYNTDTYYEFE-NH2 |
| 811 | JBS-3565 | Ac-EYYVSAGWYPYNTDTYYEFE-NH2 | 852 | JBS-3606 | Ac-EYYVSAGWYDRNTDTYYEFE-NH2 |
| 812 | JBS-3566 | Ac-EYYVSAGWYDPNTDTYYEFE-NH2 | 853 | JBS-3607 | Ac-EYYVSAGWYDYRTDTYYEFE-NH2 |
| 813 | JBS-3567 | Ac-EYYVSAGWYDYPTDTYYEFE-NH2 | 854 | JBS-3608 | Ac-EYYVSAGWYDYNRDTYYEFE-NH2 |
| 814 | JBS-3568 | Ac-EYYVSAGWYDYNPDTYYEFE-NH2 | 855 | JBS-3609 | Ac-EYYVSAGWYDYNTRTYYEFE-NH2 |
| 815 | JBS-3569 | Ac-EYYVSAGWYDYNTPTYYEFE-NH2 | 856 | JBS-3610 | Ac-EYYVSAGWYDYNTDRYYEFE-NH2 |
| 816 | JBS-3570 | Ac-EYYVSAGWYDYNTDPYYEFE-NH2 | 857 | JBS-3611 | Ac-EYYVSAGWYDYNTDTRYEFE-NH2 |
| 817 | JBS-3571 | Ac-EYYVSAGWYDYNTDTPYEFE-NH2 | 858 | JBS-3612 | Ac-EYYVSAGWYDYNTDTYREFE-NH2 |
| 818 | JBS-3572 | Ac-EYYVSAGWYDYNTDTYPEFE-NH2 | 859 | JBS-3613 | Ac-EYYVSAGWYDYNTDTYYRFE-NH2 |
| 819 | JBS-3573 | Ac-EYYVSAGWYDYNTDTYYPFE-NH2 | 860 | JBS-3614 | Ac-EYYVSAGWYDYNTDTYYERE-NH2 |
| 820 | JBS-3574 | Ac-EYYVSAGWYDYNTDTYYEPE-NH2 | 861 | JBS-3615 | Ac-EYYVSAGWYDYNTDTYYEFR-NH2 |
| 821 | JBS-3575 | Ac-EYYVSAGWYDYNTDTYYEFP-NH2 | 862 | JBS-3616 | Ac-SYYVSAGWYDYNTDTYYEFE-NH2 |
| 822 | JBS-3576 | Ac-QYYVSAGWYDYNTDTYYEFE-NH2 | 863 | JBS-3617 | Ac-ESYVSAGWYDYNSDTYYEFE-NH2 |
| 823 | JBS-3577 | Ac-EQYVSAGWYDYNTDTYYEFE-NH2 | 864 | JBS-3618 | Ac-EYSVSAGWYDYNTDTYYEFE-NH2 |
| 824 | JBS-3578 | Ac-EYQVSAGWQDYNTDTYYEFE-NH2 | 865 | JBS-3619 | Ac-EYYSSAGWYDYNTDTYYEFE-NH2 |
| 825 | JBS-3579 | Ac-EYYQSAGWYDYNTDTYYEFE-NH2 | 866 | JBS-3620 | Ac-EYYVSSGWYDYNTDTYYEFE-NH2 |
| 826 | JBS-3580 | Ac-EYYVQAGWYDQTDTYYEFE-NH2 | 867 | JBS-3621 | Ac-EYYVSAGSYDYNTDTYYEFE-NH2 |
| 827 | JBS-3581 | Ac-EYYVSAGWYQGWYDYNTDTYYEFE-NH2 | 868 | JBS-3622 | Ac-EYYVSAGWSDYNTDTYYEFE-NH2 |
| 828 | JBS-3582 | Ac-EYYVSAQWYDYNTDTYYEFE-NH2 | 869 | JBS-3623 | Ac-EYYVSAGWYSYNTDTYYEFE-NH2 |
| 829 | JBS-3583 | Ac-EYYVSAGQYDYNTDTYYEFE-NH2 | 870 | JBS-3624 | Ac-EYYVSAGWYSNTDTYYEFE-NH2 |
| 830 | JBS-3584 | Ac-EYYVSAGWQDYNTDTYYEFE-NH2 | 871 | JBS-3625 | Ac-EYYVSAGWYDYNSTDTYYEFE-NH2 |
| 831 | JBS-3585 | Ac-EYYVSAGWYDNTDTYYEFE-NH2 | 872 | JBS-3626 | Ac-EYYVSAGWYDYSTDTYYEFE-NH2 |
| 832 | JBS-3586 | Ac-EYYVSAGWYDQTDTYYEFE-NH2 | 873 | JBS-3627 | Ac-EYYVSAGWYDYNSDTYYEFE-NH2 |
| 833 | JBS-3587 | Ac-EYYVSAGWYDQTDTYYEFE-NH2 | 874 | JBS-3628 | Ac-EYYVSAGWYDYNTSYYEFE-NH2 |
| 834 | JBS-3588 | Ac-EYYVSAGWYDYNQDTYYEFE-NH2 | 875 | JBS-3629 | Ac-EYYVSAGWYDYNTDSYYEFE-NH2 |
| 835 | JBS-3589 | Ac-EYYVSAGWYDYNTDQYYEFE-NH2 | 876 | JBS-3630 | Ac-EYYVSAGWYDYNTDTSYEFE-NH2 |
| 836 | JBS-3590 | Ac-EYYVSAGWYDYNTDTQYEFE-NH2 | 877 | JBS-3631 | Ac-EYYVSAGWYDYNTDTYSFE-NH2 |
| 837 | JBS-3591 | Ac-EYYVSAGWYDYNTDTQEFE-NH2 | 878 | JBS-3632 | Ac-EYYVSAGWYDYNTDTYYSFE-NH2 |
| 838 | JBS-3592 | Ac-EYYVSAGWYDYNTDTYQEFE-NH2 | 879 | JBS-3633 | Ac-EYYVSAGWYDYNTDTYYESE-NH2 |
| 839 | JBS-3593 | Ac-EYYVSAGWYDYNTDTYYQFE-NH2 | 880 | JBS-3634 | Ac-EYYVSAGWYDYNTDTYYEFS-NH2 |
| 840 | JBS-3594 | Ac-EYYVSAGWYDYNTDTYYEQE-NH2 | 881 | JBS-3635 | Ac-TYYVSAGWYDYNTDTYYEFE-NH2 |
| 841 | JBS-3595 | Ac-EYYVSAGWYDYNTDTYYEFQ-NH2 | 882 | JBS-3636 | Ac-ETYVSAGWYDYNTDTYYEFE-NH2 |
| 842 | JBS-3596 | Ac-RYYVSAGWYDYNTDTYYEFE-NH2 | 883 | JBS-3637 | Ac-EYTVSAGWYDYNTDTYYEFE-NH2 |
| 843 | JBS-3597 | Ac-ERYVSAGWYDYNTDTYYEFE-NH2 | 884 | JBS-3638 | Ac-EYYTSAGWYDYNTDTYYEFE-NH2 |
| 844 | JBS-3598 | Ac-EYRVSAGWYDYNTDTYYEFE-NH2 | 885 | JBS-3639 | Ac-EYYVSTGWYDYNTDTYYEFE-NH2 |

FIGURE 2K

| SEQ ID | Compound | Sequence | SEQ ID | Compound | Sequence |
|---|---|---|---|---|---|
| 886 | JBS-3640 | Ac-EYYVSATWDYNTDTYYEFE-NH2 | 927 | JBS-3681 | Ac-EYYVSAGWYDYNWDTYYEFE-NH2 |
| 887 | JBS-3641 | Ac-EYYVSAGTYDYNTDTYYEFE-NH2 | 928 | JBS-3682 | Ac-EYYVSAGWYDYNTWTYYEFE-NH2 |
| 888 | JBS-3642 | Ac-EYYVSAGWTDYNTDTYYEFE-NH2 | 929 | JBS-3683 | Ac-EYYVSAGWYDYNTDWYYEFE-NH2 |
| 889 | JBS-3643 | Ac-EYYVSAGWYTYNTDTYYEFE-NH2 | 930 | JBS-3684 | Ac-EYYVSAGWYDYNTDTWEFE-NH2 |
| 890 | JBS-3644 | Ac-EYYVSAGWYDTNTDTYYEFE-NH2 | 931 | JBS-3685 | Ac-EYYVSAGWYDYNTDTYWEFE-NH2 |
| 891 | JBS-3645 | Ac-EYYVSAGWYDYTTDTYYEFE-NH2 | 932 | JBS-3686 | Ac-EYYVSAGWYDYNTDTYYWFE-NH2 |
| 892 | JBS-3646 | Ac-EYYVSAGWYDYNTTTYYEFE-NH2 | 933 | JBS-3687 | Ac-EYYVSAGWYDYNTDTYYEWE-NH2 |
| 893 | JBS-3647 | Ac-EYYVSAGWYDYNTDTYEFE-NH2 | 934 | JBS-3688 | Ac-EYYVSAGWYDYNTDTYYEFW-NH2 |
| 894 | JBS-3648 | Ac-EYYVSAGWYDYNTDTYYFFE-NH2 | 935 | JBS-3689 | Ac-YYYVSAGWYDYNTDTYYEFE-NH2 |
| 895 | JBS-3649 | Ac-EYYVSAGWYDYNTDTYYTFE-NH2 | 936 | JBS-3690 | Ac-EYYVSAGWYDYNTDTYYEFE-NH2 |
| 896 | JBS-3650 | Ac-EYYVSAGWYDYNTDTYYETE-NH2 | 937 | JBS-3691 | Ac-EYYVYAGWYDYNTDTYYEFE-NH2 |
| 897 | JBS-3651 | Ac-VYYVSAGWYDYNTDTYYEFE-NH2 | 938 | JBS-3692 | Ac-EYYVSYGWYDYNTDTYYEFE-NH2 |
| 898 | JBS-3652 | Ac-EYYVSAGWYDYNTDTYYEFE-NH2 | 939 | JBS-3693 | Ac-EYYVSAYWYDYNTDTYYEFE-NH2 |
| 899 | JBS-3653 | Ac-EYYVAGWYDYNTDTYYEFE-NH2 | 940 | JBS-3694 | Ac-EYYVSAGWYYDYNTDTYYEFE-NH2 |
| 900 | JBS-3654 | Ac-EYYVSAGWYDYNTDTYYEFE-NH2 | 941 | JBS-3695 | Ac-EYYVSAGWNYDYNTDTYYEFE-NH2 |
| 901 | JBS-3655 | Ac-EYYVSVGWYDYNTDTYYEFE-NH2 | 942 | JBS-3696 | Ac-EYYVSAGWYDYTDTYYEFE-NH2 |
| 902 | JBS-3656 | Ac-EYYVSAVWYDYNTDTYYEFE-NH2 | 943 | JBS-3697 | Ac-EYYVSAGWYDYNYDTYYEFE-NH2 |
| 903 | JBS-3657 | Ac-EYYVSAGVYDYNTDTYYEFE-NH2 | 944 | JBS-3698 | Ac-EYYVSAGWYDYNTYTYYEFE-NH2 |
| 904 | JBS-3658 | Ac-EYYVSAGWVDYNTDTYYEFE-NH2 | 945 | JBS-3699 | Ac-EYYVSAGWYDYNTDYYYEFE-NH2 |
| 905 | JBS-3659 | Ac-EYYVSAGWYVYNTDTYYEFE-NH2 | 946 | JBS-3700 | Ac-EYYVSAGWYDYNTDTYYFE-NH2 |
| 906 | JBS-3660 | Ac-EYYVSAGWYDVNTDTYYEFE-NH2 | 947 | JBS-3701 | Ac-EYYVSAGWYDYNTDTYYEYE-NH2 |
| 907 | JBS-3661 | Ac-EYYVSAGWYDYVTDTYYEFE-NH2 | 948 | JBS-3702 | Ac-EYYVSAGWYDYNTDTYYEFY-NH2 |
| 908 | JBS-3662 | Ac-EYYVSAGWYDYNVDTYYEFE-NH2 | 949 | JBS-3703 | Ac-eYYVSAGwYDYNTDTYYEFE-NH2 |
| 909 | JBS-3663 | Ac-EYYVSAGWYDYNTVTYYEFE-NH2 | 950 | JBS-3704 | Ac-EYYVSAGWyDYNTDTYYEFE-NH2 |
| 910 | JBS-3664 | Ac-EYYVSAGWYDYNTDVYYEFE-NH2 | 951 | JBS-3705 | Ac-EYYVSAGWYDYNTDTYYEFE-NH2 |
| 911 | JBS-3665 | Ac-EYYWSAGWYDYNTDTYYEFE-NH2 | 952 | JBS-3706 | Ac-EYYvSAGWYDYNTDTYYEFE-NH2 |
| 912 | JBS-3666 | Ac-EYYVWAGWYDYNTDTYYEFE-NH2 | 953 | JBS-3707 | Ac-EYYVSAGWYDYNtDTYYEFE-NH2 |
| 913 | JBS-3667 | Ac-EYYVSWGWYDYNTDTYYVFE-NH2 | 954 | JBS-3708 | Ac-EYYVSaGWYDYNTDtYYEFE-NH2 |
| 914 | JBS-3668 | Ac-EYYVSAWWYDYNTDTYYEVE-NH2 | 955 | JBS-3709 | Ac-EYYVSAGWYDYNTDtYYEFE-NH2 |
| 915 | JBS-3669 | Ac-EYYVSAGWWYDYNTDTYYEFV-NH2 | 956 | JBS-3710 | Ac-EYYVSAGwyDYNTDTYYEFE-NH2 |
| 916 | JBS-3670 | Ac-WYYVSAGWYDYNTDTYYEFE-NH2 | 957 | JBS-3711 | Ac-EYYVSAGwyDYNTDTYYEFE-NH2 |
| 917 | JBS-3671 | Ac-EWYVSAGWYDYNTDTYYEFE-NH2 | 958 | JBS-3712 | Ac-EYYVSAGWyDYNTDTYYEFE-NH2 |
| 918 | JBS-3672 | Ac-EYWVSAGWYDYNTDTYYEFE-NH2 | 959 | JBS-3713 | Ac-EYYVSAGWYdYNTDTYYEFE-NH2 |
| 919 | JBS-3673 | Ac-EYYWSAGWYDYNTDTYYEFE-NH2 | 960 | JBS-3714 | Ac-EYYVSAGWYDyNTDTYYEFE-NH2 |
| 920 | JBS-3674 | Ac-EYYVWAGWYDYNTDTYYEFE-NH2 | 961 | JBS-3715 | Ac-EYYVSAGWYDYntDTYYEFE-NH2 |
| 921 | JBS-3675 | Ac-EYYVSWGWYDYNTDTYYEFE-NH2 | 962 | JBS-3716 | Ac-EYYVSAGWYDYNTdTYYEFE-NH2 |
| 922 | JBS-3676 | Ac-EYYVSAWWYDYNTDTYYEFE-NH2 | 963 | JBS-3717 | Ac-EYYVSAGWYDYNTDtYYEFE-NH2 |
| 923 | JBS-3677 | Ac-EYYVSAGWWYDYNTDTYYEFE-NH2 | 964 | JBS-3718 | Ac-EYYVSAGWYDYNTDTyYEFE-NH2 |
| 924 | JBS-3678 | Ac-EYYVSAGWWYNTDTYYEFE-NH2 | 965 | JBS-3719 | Ac-EYYVSAGWYDYNTDTYyEFE-NH2 |
| 925 | JBS-3679 | Ac-EYYVSAGWYDMNTDTYYEFE-NH2 | 966 | JBS-3720 | Ac-EYYVSAGWYDYNTDTYYeFE-NH2 |
| 926 | JBS-3680 | Ac-EYYVSAGWYDWTDTYYEFE-NH2 | 967 | JBS-3721 | Ac-EYYVSAGWYDYNTDTYYEfE-NH2 |

FIGURE 2L

| SEQ ID | Compound | Sequence | SEQ ID | Compound | Sequence |
|---|---|---|---|---|---|
| 968 | JBS-3722 | Ac-EYYVSAGWYDYNTDTYYEFe-NH2 | 1007 | JBS-0448 | Bio-Ttds-RGLEEQET[CVRVSSRVEIC]W-NH2 |
| 969 | JBS-3723 | Ac-pYYVSAGWYDYNTDTYYEFE-NH2 | 1008 | JBS-0449 | Bio-Ttds-NW[CIAISPTMDLC]LYLRKEN-NH2 |
| 970 | JBS-3724 | Ac-EpYVSAGWYDYNTDTYYEFE-NH2 | 1009 | JBS-0450 | Bio-Ttds-LDDM[CYALTEHVSIC]YGAAS-NH2 |
| 971 | JBS-3725 | Ac-EYpVSAGWYDYNTDTYYEFE-NH2 | 1010 | JBS-0451 | Bio-Ttds-RREM[CHALGGMVTVC]VGWEW-NH2 |
| 972 | JBS-3726 | Ac-EYYpSAGWYDYNTDTYYEFE-NH2 | 1011 | JBS-0452 | Bio-Ttds-VFQKEE[CVLATSVWVC]WGN-NH2 |
| 973 | JBS-3727 | Ac-EYYVpAGWYDYNTDTYYEFE-NH2 | 1012 | JBS-0453 | Bio-Ttds-WEV[CVPLSAGGMIC]VGRTDR-NH2 |
| 974 | JBS-3728 | Ac-EYYVSpGWYDYNTDTYYEFE-NH2 | 1013 | JBS-0454 | Bio-Ttds-VWL[CLEETGLC]VQVLGAARF-NH2 |
| 975 | JBS-3729 | Ac-EYYVSApWYDYNTDTYYEFE-NH2 | 1014 | JBS-0455 | Bio-Ttds-ANKMLGSSGPWYWIEVGWSS-NH2 |
| 976 | JBS-3730 | Ac-EYYVSAgpYDYNTDTYYEFE-NH2 | 1015 | JBS-0456 | Bio-Ttds-GGSLSIHIDWGWAPSSRWTH-NH2 |
| 977 | JBS-3731 | Ac-EYYVSAGWpDYNTDTYYEFE-NH2 | 1016 | JBS-0457 | Bio-Ttds-WRHGAIQWGWSESSRYRHSL-NH2 |
| 978 | JBS-3732 | Ac-EYYVSAGWYpNTDTYYEFE-NH2 | 1017 | JBS-0458 | Bio-Ttds-WFGWTWGLTRSSEYQHSGNK-NH2 |
| 979 | JBS-3733 | Ac-EYYVSAGWYDpNTDTYYEFE-NH2 | 1018 | JBS-0459 | Bio-Ttds-GRNVKRSYWGVVDWGWEESS-NH2 |
| 980 | JBS-3734 | Ac-EYYVSAGWYDpTDTYYEFE-NH2 | 1019 | JBS-0460 | Bio-Ttds-GLGWEVGWHVLESSHDLTIH-NH2 |
| 981 | JBS-3735 | Ac-EYYVSAGWYDYNpDTYYEFE-NH2 | 1020 | JBS-0461 | Bio-Ttds-YYVAVGWYRITTGESMWMMV-NH2 |
| 982 | JBS-3736 | Ac-EYYVSAGWYDYNTpTYYEFE-NH2 | 1021 | JBS-0462 | Bio-Ttds-YSVQVGWYMDASHYQHAMRH-NH2 |
| 983 | JBS-3737 | Ac-EYYVSAGWYDYNTDpYYEFE-NH2 | 1022 | JBS-0463 | Bio-Ttds-VIRVGWYNNRVSGQIMWVGLI-NH2 |
| 984 | JBS-3738 | Ac-EYYVSAGWYDYNTDTpYEFE-NH2 | 1023 | JBS-0464 | Bio-Ttds-WVLGWYDKALETEYDYMYGG-NH2 |
| 985 | JBS-3739 | Ac-EYYVSAGWYDYNTDTYpEFE-NH2 | 1024 | JBS-0465 | Bio-Ttds-VEVGWYLVDRDVWMLWSDHE-NH2 |
| 986 | JBS-3740 | Ac-EYYVSAGWYDYNTDTYYpFE-NH2 | 1025 | JBS-0466 | Bio-Ttds-GWFMEVATVLGVIEVGWVV-NH2 |
| 987 | JBS-3741 | Ac-EYYVSAGWYDYNTDTYYEpE-NH2 | 1026 | JBS-0467 | Bio-Ttds-MWIGWHTVSEESDHWFAWVT-NH2 |
| 988 | JBS-3742 | Ac-EYYVSAGWYDYNTDTYYEFp-NH2 | 1027 | JBS-0468 | Bio-Ttds-WENETLLRLPSGAMVWVGFT-NH2 |
| 989 | JBS-3743 | Ac-YYVSAGWYDYNTDTYYEFE-NH2 | 1028 | JBS-0469 | Bio-Ttds-RLGIQLWGATLSQEWLVWEL-NH2 |
| 990 | JBS-3744 | Ac-YVSAGWYDYNTDTYYEFE-NH2 | 1029 | JBS-0470 | Bio-Ttds-NYVRTEVLWENEVVGVWLEW-NH2 |
| 991 | JBS-3745 | Ac-VSAGWYDYNTDTYYEFE-NH2 | 1030 | JBS-0471 | Bio-Ttds-GLSWHLYLGNGGTVTIGYET-NH2 |
| 992 | JBS-3746 | Ac-SAGWYDYNTDTYYEFE-NH2 | 1031 | JBS-0472 | Bio-Ttds-SLGHVHMGRRYTVELRWERA-NH2 |
| 993 | JBS-3747 | Ac-EYYVSAGWYDYNTDTYYF-NH2 | 1032 | JBS-0473 | Bio-Ttds-ELPLALQGMESHGIVSWGWA-NH2 |
| 994 | JBS-3748 | Ac-EYYVSAGWYDYNTDTYY-NH2 | 1033 | JBS-0474 | Bio-Ttds-FGSEWQIMILLDSGDEYMLG-NH2 |
| 995 | JBS-3750 | Ac-YVSAGWYDYNTDTYYEF-NH2 | 1034 | JBS-0475 | Bio-Ttds-IFGVIETFAGTVSFGWENYD-NH2 |
| 996 | JBS-3751 | Ac-VSAGWYDYNTDTYYE-NH2 | 1035 | JBS-0476 | Bio-Ttds-KDNEELVLMRGRLEIWLGME-NH2 |
| 997 | JBS-3752 | Ac-SAGWYDYNTDTYY-NH2 | 1036 | JBS-0477 | Bio-Ttds-RPTTLRLGANSWIEIGWEI-NH2 |
| 998 | JBS-3753 | Ac-AGWYDYNTDTY-NH2 | 1037 | JBS-0478 | Bio-Ttds-YILWSYVGPGIEVGWTESA-NH2 |
| 999 | JBS-3754 | Ac-EYYVSAGWYDYN_DTYYEFE-K([Ttds-Mal-MSA]-NH2 | 1038 | JBS-0479 | Bio-Ttds-WKVWRLGGVELWYKEFGSER-NH2 |
| 1000 | JBS-3755 | Me-200HS-Ahx-EYYVSAGWYDYNTDTYYEFEK(Me-2COHS)-NE2 | 1039 | JBS-0480 | Bio-Ttds-REREFRINFYVSWGWEPSGI-NH2 |
| 1001 | JBS-3756 | Me-200GS-Ahx-EYYVSAGWYDYNTDTYYEFEK(Me-2COGS)-NE2 | 1040 | JBS-0481 | Bio-Ttds-LRKRLTNLDSIFVVELWWEY-NH2 |
| 1002 | JBS-3757 | Ac EYYVSAGWYDYNTDTYYEFE K(Oddc cGlu Ttds) NH2 | 1041 | JBS-0482 | Bio-Ttds-WWVINNVMVGWEFVQPGEFT-NH2 |
| 1003 | JBS-3758 | GL2-200GS2-Ahx-EYYVSAGWYDYNTDTYYEFE-K(Oddc cGlu Ttds)NH2 | 1042 | JBS-0483 | Bio-Ttds-HEQIVTLMYHHRETGVDYRS-NH2 |
| 1004 | JBS-3760 | Glutar-Atx-EYYVSAGWYDYNTDTYYEFE-K(Glutar)-NH2 | 1043 | JBS-0484 | Bio-Ttds-GRWKSGESTWTVELFWVWNG-NH2 |
| 1005 | JBS-3761 | Ac-EYYVSAGWYDYNTDTYYEFE-K(Ttds-Mal-HSA)-NH2 | 1044 | JBS-0485 | Bio-Ttds-VEWELWEVVEGQEVRVKL-NH2 |
| 1006 | JBS-0447 | Bio-Ttds-VLSWSV[CYLQQEAYRSTIIC]-NH2 | 1045 | JBS-0486 | Bio-Ttds-WMVKFSVVRGITEVGWEVLD-NH2 |

FIGURE 2M

| SEQ ID | Compound | Sequence | SEQ ID | Compound | Sequence |
|---|---|---|---|---|---|
| 1046 | JBS-0487 | Bio-Ttds-GFAIWIGLIKGHHSYEWELR-NH2 | 1087 | JBS-0547 | Bio-Ttds-FATLHEWRSGFMRHRHLRAS-NH2 |
| 1047 | JBS-0488 | Bio-Ttds-ESTIEFWIEGKLVPEFIFTY-NH2 | 1088 | JBS-0548 | Bio-Ttds-HGDSMWKWTVMRAPATGRGM-NH2 |
| 1048 | JBS-0489 | Bio-Ttds-HLYLMWQRWPSPWVEVGWEFV-NH2 | 1089 | JBS-0549 | Bio-Ttds-GHGMRWHRRLEAIMDIKRL-NH2 |
| 1049 | JBS-0507 | Bio-Ttds-GSTVQV[CWYWEEVEVEIC]VS-NH2 | 1090 | JBS-0550 | Bio-Ttds-RRYERATASSRRESQLVDSI-NH2 |
| 1050 | JBS-0508 | Bio-Ttds-GNAKVWL[CVEDKHMTVC]TLI-NH2 | 1091 | JBS-0551 | Bio-Ttds-GGHCTHTPWTYGYLAWVSRT-NH2 |
| 1051 | JBS-0510 | Bio-Ttds-DLDPRIVLVGNGEIEIGWSI-NH2 | 1092 | JBS-0552 | Bio-Ttds-FWSMGYQSLDGEWTSEWARI-NH2 |
| 1052 | JBS-0511 | Bio-Ttds-DQVWWWGFKARMGLIEYGWE-NH2 | 1093 | JBS-0553 | Bio-Ttds-TRSGERGRKRVLSSYWLHSW-NH2 |
| 1053 | JBS-0512 | Bio-Ttds-NQGYTHNTKLRFYVELGWEH-NH2 | 1094 | JBS-0554 | Bio-Ttds-WHWWMGTYQSSPWSTETEWW-NH2 |
| 1054 | JBS-0513 | Bio-Ttds-WIEVGWFEANTGRHRTWTIV-NH2 | 1095 | JBS-0555 | Bio-Ttds-SSGHPRVRSKYSWGLIPLRR-NH2 |
| 1055 | JBS-0515 | Bio-Ttds-IMVGWEDVRRGRILEEITWK-NH2 | 1096 | JBS-0556 | Bio-Ttds-TGIYAWGWEIRSEWQNDSWF-NH2 |
| 1056 | JBS-0516 | Bio-Ttds-KYLLLDFTFWLTKEVGVGW-NH2 | 1097 | JBS-0557 | Bio-Ttds-GWNVFYIFRVFEGKPKAWVM-NH2 |
| 1057 | JBS-0517 | Bio-Ttds-VWVGWTERRGSKEQVLWEVK-NH2 | 1098 | JBS-0558 | Bio-Ttds-GGTLWQFEHGEHYLIMLGWE-NH2 |
| 1058 | JBS-0518 | Bio-Ttds-EVRYRFEGIPFFHVIFGWEF-NH2 | 1099 | JBS-0559 | Bio-Ttds-LEGNHWRDRYHHSVKASVPM-NH2 |
| 1059 | JBS-0519 | Bio-Ttds-YSVLVWRAGGGQVELMMSRV-NH2 | 1100 | JBS-0560 | Bio-Ttds-IWGAQRWDHRKGLVSMSMS-NH2 |
| 1060 | JBS-0520 | Bio-Ttds-PIWERDSVPRMMYSIELYWE-NH2 | 1101 | JBS-0561 | Bio-Ttds-RGVRRMPKSYPRQHTAIRVL-NH2 |
| 1061 | JBS-0521 | Bio-Ttds-WRWSIVVGYQWKGTDHDLWA-NH2 | 1102 | JBS-0562 | Bio-Ttds-LMAVHVPSTNNTKWVIDICK-NH2 |
| 1062 | JBS-0522 | Bio-Ttds-VYEVGWDHGNWYEIIWRYPS-NH2 | 1103 | JBS-0563 | Bio-Ttds-GIWIGQSKYIWRSQRGEQTI-NH2 |
| 1063 | JBS-0523 | Bio-Ttds-WFQREYEIKKGQIWLVIRVG-NH2 | 1104 | JBS-0564 | Bio-Ttds-YEGIKPWTGSRVMMLMDMLT-NH2 |
| 1064 | JBS-0524 | Bio-Ttds-QVWVGYYNTIEDTELVMWTV-NH2 | 1105 | JBS-0565 | Bio-Ttds-KES[CFWVSKWVAVC]GHY-NH2 |
| 1065 | JBS-0525 | Bio-Ttds-RIWIGMYLGGTLIWEWEVIP-NH2 | 1106 | JBS-0566 | Bio-Ttds-VISQGHH[CWHVNEKIAVC]WL-NH2 |
| 1066 | JBS-0526 | Bio-Ttds-YSEITIGVYMEQYSYDFYNF-NH2 | 1107 | JBS-0567 | Bio-Ttds-EREDITY[CVVVASGVELC]WQ-NH2 |
| 1067 | JBS-0527 | Bio-Ttds-VVRHWHYVGMEFGFEKVREV-NH2 | 1108 | JBS-0568 | Bio-Ttds-EH[CRQIAPDVMLC]WEWRAKS-NH2 |
| 1068 | JBS-0528 | Bio-Ttds-GES[CVRINHKVWVC]WDMGSE-NH2 | 1109 | JBS-0569 | Bio-Ttds-SAGSVS[CFWVSQSVSVC]WQL-NH2 |
| 1069 | JBS-0529 | Bio-Ttds-YERGTFHT[CSRYDERIDVC]W-NH2 | 1110 | JBS-0570 | Bio-Ttds-QLELGF-NH2 |
| 1070 | JBS-0530 | Bio-Ttds-GVIV[CYTHTCSWHGHNDWC]Y-NH2 | 1111 | JBS-0571 | Bio-Ttds-RGWTRYWIEVGWWHIDEELI-NH2 |
| 1071 | JBS-0531 | Bio-Ttds-SHRKSQLHQQYRSR[CERC]SN-NH2 | 1112 | JBS-0572 | Bio-Ttds-FVHVGMVEYGWVLRSDYRHS-NH2 |
| 1072 | JBS-0532 | Bio-Ttds-LVRVRLITQFAQYSRRSGVAF-NH2 | 1113 | JBS-0573 | Bio-Ttds-HSEVSWLRSNDYYIEFGWEW-NH2 |
| 1073 | JBS-0533 | Bio-Ttds-SSWNGQRAWMLVGMRGVAVN-NH2 | 1114 | JBS-0574 | Bio-Ttds-RDIWDLWTYRIEFGWEMSDD-NH2 |
| 1074 | JBS-0534 | Bio-Ttds-GVPGLKSRYSEGLSLDTSWL-NH2 | 1115 | JBS-0575 | Bio-Ttds-YQHGEDGWYWIEFGWEFVDL-NH2 |
| 1075 | JBS-0535 | Bio-Ttds-SVFASDLNFYFVMSAWSKIT-NH2 | 1116 | JBS-0576 | Bio-Ttds-AEKVDKRESHVSYTVELMWEY-NH2 |
| 1076 | JBS-0536 | Bio-Ttds-TLEGRRVILVMMVWRWTYHV-NH2 | 1117 | JBS-0577 | Bio-Ttds-RWQRLGKGETWEFWAYIPVV-NH2 |
| 1077 | JBS-0537 | Bio-Ttds-KWFTITRFATILHTSYIFQN-NH2 | 1118 | JBS-0578 | Bio-Ttds-WTIGLMWENEHEEVMIWQVQ-NH2 |
| 1078 | JBS-0538 | Bio-Ttds-NRIHLSWGTKNQGFTKLKRI-NH2 | 1119 | JBS-0579 | Bio-Ttds-WIKIGWHHRDHEWDEDIGFM-NH2 |
| 1079 | JBS-0539 | Bio-Ttds-QAIKGRIHGDIESDRYSVYY-NH2 | 1120 | JBS-0580 | Bio-Ttds-WELWSMDSLGKHTILGFGKW-NH2 |
| 1080 | JBS-0540 | Bio-Ttds-AGIQLVLEWYGHRVIVIQLG-NH2 | 1121 | JBS-0581 | Bio-Ttds-FRIELWYREGKSGNEKLVWS-NH2 |
| 1081 | JBS-0541 | Bio-Ttds-VYADINMLASITWFARPYMD-NH2 | 1122 | JBS-0587 | Bio-Ttds-SLGHVHMGRRYTVELRWERA-NH2 |
| 1082 | JBS-0542 | Bio-Ttds-FINVLMPRRGTPKREWAYY-NH2 | 1123 | JBS-0588 | Bio-Ttds-SVEFGFYDVENSMDWTVGWV-NH2 |
| 1083 | JBS-0543 | Bio-Ttds-WSRLLARVVWKSGTIEVGWA-NH2 | 1124 | JBS-0589 | Bio-Ttds-DK[CMQASQVVWVC]VHQEWDP-NH2 |
| 1084 | JBS-0544 | Bio-Ttds-GYWTVEFWVQWSGGDDVLIR-NH2 | 1125 | JBS-0590 | Bio-Ttds-DLDPRIVLVGNGEIEIGWSI-NH2 |
| 1085 | JBS-0545 | Bio-Ttds-EDVGKFKWYIEVWWQNMDEA-NH2 | 1126 | JBS-0591 | Bio-Ttds-EAWN[CIVVSKNISVC]WSKSY-NH2 |
| 1086 | JBS-0546 | Bio-Ttds-EDWGIRWGWRYTLRWEAVLW-NH2 | 1127 | JBS-0592 | Bio-Ttds-EGEQ[CVVLRSGGSVC]VGFER-NH2 |

FIGURE 2N

| SEQ ID | Compound | Sequence | SEQ ID | Compound | Sequence |
|---|---|---|---|---|---|
| 1128 | JBS-0593 | Bio-Ttds-ELPLALQGMESHGIVSWGWA-NH2 | 1169 | JBS-0634 | Bio-Ttds-GKYLLLDFTFWLTKEVGVGW-NH2 |
| 1129 | JBS-0594 | Bio-Ttds-EY[CIWLIDDSIAVC]WEESGN-NH2 | 1170 | JBS-0635 | Bio-Ttds-GLGWEVGWHVLESSHDLTIH-NH2 |
| 1130 | JBS-0595 | Bio-Ttds-GEY[CWEVNENVHVC]YHVPDS-NH2 | 1171 | JBS-0636 | Bio-Ttds-GLIEWGWYSRQEDQHWLMGT-NH2 |
| 1131 | JBS-0596 | Bio-Ttds-IWM[CWEDLKGSYC]WEFVRQG-NH2 | 1172 | JBS-0637 | Bio-Ttds-GRWLIGLAPQAEVWFLWQPM-NH2 |
| 1132 | JBS-0597 | Bio-Ttds-LDGGHW[CWEISDSVMLC]VAV-NH2 | 1173 | JBS-0638 | Bio-Ttds-GTEIGWLDLLTDHVIWSVTI-NH2 |
| 1133 | JBS-0598 | Bio-Ttds-LSIWL[CWEGEDHTFTVC]RVL-NH2 | 1174 | JBS-0639 | Bio-Ttds-GTQERGSKRMFTVELWWEP-NH2 |
| 1134 | JBS-0599 | Bio-Ttds-PGVEL[CWEANGWTTC]ISWPY-NH2 | 1175 | JBS-0640 | Bio-Ttds-GWFMEVATVLGVIEVGWVV-NH2 |
| 1135 | JBS-0600 | Bio-Ttds-RDEWQITV[CWLGSIYEAC]WD-NH2 | 1176 | JBS-0641 | Bio-Ttds-GWFIGLHSYHTGMESEWPG-NH2 |
| 1136 | JBS-0601 | Bio-Ttds-RGQQGDH[CTVITSFVTLC]KE-NH2 | 1177 | JBS-0642 | Bio-Ttds-HLHYNGGTIVWGSEPFNASW-NH2 |
| 1137 | JBS-0602 | Bio-Ttds-RS[CIRINERLELC]WEKTDLE-NH2 | 1178 | JBS-0643 | Bio-Ttds-HMRGTATSERRYWIEVGWFD-NH2 |
| 1138 | JBS-0603 | Bio-Ttds-SGGLYQ[CWGDDRIMLC]WAYD-NH2 | 1179 | JBS-0644 | Bio-Ttds-HMTVEFGYYWVEMDTNTVIW-NH2 |
| 1139 | JBS-0604 | Bio-Ttds-SVGIWL[CWMDSRGSVC]HQLK-NH2 | 1180 | JBS-0645 | Bio-Ttds-IEVGWYNVVTQKHSKLGMLI-NH2 |
| 1140 | JBS-0605 | Bio-Ttds-TRAMGAI[CHRITEHVSVC]YM-NH2 | 1181 | JBS-0646 | Bio-Ttds-ISVGMYFWAIDNYKEFGNTL-NH2 |
| 1141 | JBS-0606 | Bio-Ttds-TRTMGAI[CHRITEHVSVC]YM-NH2 | 1182 | JBS-0647 | Bio-Ttds-KFKRMEIGFMLESGEEYVLA-NH2 |
| 1142 | JBS-0607 | Bio-Ttds-VDH[CTPLSRERAQVWVC]WEV-NH2 | 1183 | JBS-0648 | Bio-Ttds-KVWSRVQIIRGGWIEVGYEF-NH2 |
| 1143 | JBS-0608 | Bio-Ttds-VRNITVWV[CWYERSSTREWC]H-NH2 | 1184 | JBS-0649 | Bio-Ttds-LGVEMGYHVYQTGEDYIVLT-NH2 |
| 1144 | JBS-0609 | Bio-Ttds-VSVWI[CWETLEGVPLEC]KLM-NH2 | 1185 | JBS-0650 | Bio-Ttds-LGVEMGYHVYQTGGDYIVLT-NH2 |
| 1145 | JBS-0610 | Bio-Ttds-VWI[CAVAARGPDIC]YYLVMA-NH2 | 1186 | JBS-0651 | Bio-Ttds-LIEAGYHDIASQSDRILVRY-NH2 |
| 1146 | JBS-0611 | Bio-Ttds-WQWEVLM[CNDHNTVC]VGLLIQ-NH2 | 1187 | JBS-0652 | Bio-Ttds-LIVFGYSYIETEEEFIISLH-NH2 |
| 1147 | JBS-0612 | Bio-Ttds-WYGHDY[CFKFSREIWIC]QMD-NH2 | 1188 | JBS-0653 | Bio-Ttds-LLMHTGDHSVSLFYEVLDYP-NH2 |
| 1148 | JBS-0613 | Bio-Ttds-AEIEWGWYVSDAEEFIVLGH-NH2 | 1189 | JBS-0654 | Bio-Ttds-LMMVRILRIDGAEVVGWEL-NH2 |
| 1149 | JBS-0614 | Bio-Ttds-AFWEAGWYDSVGNSWNVFFK-NH2 | 1190 | JBS-0655 | Bio-Ttds-MGLWYGWEYVNGLGGHEIEI-NH2 |
| 1150 | JBS-0615 | Bio-Ttds-AGVASEVTWGWINMVDDTH-NH2 | 1191 | JBS-0656 | Bio-Ttds-NHVWEVQLDKSVWIGWEWID-NH2 |
| 1151 | JBS-0616 | Bio-Ttds-AIELGYYSQSTDSSIILWQE-NH2 | 1192 | JBS-0657 | Bio-Ttds-NSSNSNGQKFRYFIEVGWYH-NH2 |
| 1152 | JBS-0617 | Bio-Ttds-AIEVGWYYLESTHEVFTNA-NH2 | 1193 | JBS-0658 | Bio-Ttds-NTTGRIELWIQLPDRDWLLW-NH2 |
| 1153 | JBS-0618 | Bio-Ttds-AWTWEFGTYNFMTDSYTLQW-NH2 | 1194 | JBS-0659 | Bio-Ttds-PYFVELGYEQGVFYKIELL-NH2 |
| 1154 | JBS-0619 | Bio-Ttds-DSTIVGWYSYDHDYDIWGY-NH2 | 1195 | JBS-0660 | Bio-Ttds-PYGVWYSWDNTSWLQISTHV-NH2 |
| 1155 | JBS-0620 | Bio-Ttds-EHRHTRSKDPYYSVELMWEF-NH2 | 1196 | JBS-0661 | Bio-Ttds-QFFGLISGDGRLQIWIGWYE-NH2 |
| 1156 | JBS-0621 | Bio-Ttds-EIEVGYETFESGEAVWWVAF-NH2 | 1197 | JBS-0662 | Bio-Ttds-QGKYGIVAWGWVPSGGHRYQ-NH2 |
| 1157 | JBS-0622 | Bio-Ttds-ELVLVWESTDGRVQLWAQWD-NH2 | 1198 | JBS-0663 | Bio-Ttds-QIQWGYEYASGWQNWWERSN-NH2 |
| 1158 | JBS-0623 | Bio-Ttds-EVRWELGIESRFSGWYMVLG-NH2 | 1199 | JBS-0664 | Bio-Ttds-QVELMFEDRSTGQQYRLATI-NH2 |
| 1159 | JBS-0624 | Bio-Ttds-EWQVTSTVWIGWELQMDLAT-NH2 | 1200 | JBS-0665 | Bio-Ttds-QVSSIELWAEYGDVPRLIWS-NH2 |
| 1160 | JBS-0625 | Bio-Ttds-EYAVWELGYYSMWEDDHVII-NH2 | 1133 | JBS-0598 | Bio-Ttds-LSIWL[CWEGEDHTFTVC]RVL-NH2 |
| 1161 | JBS-0626 | Bio-Ttds-FDVPLWAWSSGEMYIEIGLH-NH2 | 1134 | JBS-0599 | Bio-Ttds-PGVEL[CWEANGWTTC]ISWPY-NH2 |
| 1162 | JBS-0627 | Bio-Ttds-FGVVAVGYDREYDKWTLIA-NH2 | 1135 | JBS-0600 | Bio-Ttds-RDEWQITV[CWLGSIYEAC]WD-NH2 |
| 1163 | JBS-0628 | Bio-Ttds-FIVVGAYSKLTGLHIQWGYE-NH2 | 1136 | JBS-0601 | Bio-Ttds-RGQQGDH[CTVITSFVTLC]KE-NH2 |
| 1164 | JBS-0629 | Bio-Ttds-FSGSGPWFVYLIGGSIEMGY-NH2 | 1137 | JBS-0602 | Bio-Ttds-RS[CIRINERLELC]WEKTDLE-NH2 |
| 1165 | JBS-0630 | Bio-Ttds-FVSLMWETSNGRGEIARWII-NH2 | 1138 | JBS-0603 | Bio-Ttds-SGGLYQ[CWGDDRIMLC]WAYD-NH2 |
| 1166 | JBS-0631 | Bio-Ttds-GAAWFITLDGGTVEIGWEQI-NH2 | 1139 | JBS-0604 | Bio-Ttds-SVGIWL[CWMDSRGSVC]HQLK-NH2 |
| 1167 | JBS-0632 | Bio-Ttds-GFYWEVGFYDYGSDSINVHA-NH2 | 1140 | JBS-0605 | Bio-Ttds-TRAMGAI[CHRITEHVSVC]YM-NH2 |
| 1168 | JBS-0633 | Bio-Ttds-GHSVEIGWYNVAKDQPDMYY-NH2 | 1141 | JBS-0606 | Bio-Ttds-TRTMGAI[CHRITEHVSVC]YM-NH2 |

FIGURE 20

| SEQ ID | Compound | Sequence | SEQ ID | Compound | Sequence |
|---|---|---|---|---|---|
| 1142 | JBS-0607 | Bio-Ttds-VDH[CTPLSRERAQWWC]WEV-NH2 | 1183 | JBS-0648 | Bio-Ttds-KVWSRVQIIRGGWIEVGYEF-NH2 |
| 1143 | JBS-0608 | Bio-Ttds-VRNTVWV[CWYERSSTREWC]H-NH2 | 1184 | JBS-0649 | Bio-Ttds-LGVEMGYHVYQTGEDYIVLT-NH2 |
| 1144 | JBS-0609 | Bio-Ttds-VSVWI[CWETLEGVPLEC]KLW-NH2 | 1185 | JBS-0650 | Bio-Ttds-LGVEMGYHVYQTGDYIVLI-NH2 |
| 1145 | JBS-0610 | Bio-Ttds-VWI[CAVAARGPDIC]YYLVNA-NH2 | 1186 | JBS-0651 | Bio-Ttds-LIEAGYHDIASQSDRILVRY-NH2 |
| 1146 | JBS-0611 | Bio-Ttds-WQWEVLW[CNDHNTVC]VGLIQ-NH2 | 1187 | JBS-0652 | Bio-Ttds-LIVFGYSYIETEEFIISLH-NH2 |
| 1147 | JBS-0612 | Bio-Ttds-WYGHDY[CFKFSREIWTC]QMD-NH2 | 1188 | JBS-0653 | Bio-Ttds-LLWHTGDHSVSLFYEVLDYP-NH2 |
| 1148 | JBS-0613 | Bio-Ttds-AEIEWGWYSDAEEFIVLGH-NH2 | 1189 | JBS-0654 | Bio-Ttds-LWMVRILRTDGAEVVVGWEL-NH2 |
| 1149 | JBS-0614 | Bio-Ttds-AFWEAGWYDSVGNSWNVFFK-NH2 | 1190 | JBS-0655 | Bio-Ttds-MGLWYGWEYVNGLGGHEIEI-NH2 |
| 1150 | JBS-0615 | Bio-Ttds-AGVAVSEVTWGWYNMVDDTH-NH2 | 1185 | JBS-0650 | Bio-Ttds-LGVEMGYHVYQTGDYIVLI-NH2 |
| 1151 | JBS-0616 | Bio-Ttds-AIELGYYSQCIDSSIILWQE-NH2 | 1186 | JBS-0651 | Bio-Ttds-LIEAGYHDIASQSDRILVRY-NH2 |
| 1152 | JBS-0617 | Bio-Ttds-AIEVGWYYLESTRHEVFTNA-NH2 | 1187 | JBS-0652 | Bio-Ttds-LIVFGYSYIETEEFIISLH-NH2 |
| 1153 | JBS-0618 | Bio-Ttds-AWTWEFGTYNFMTDSYTLQW-NH2 | 1188 | JBS-0653 | Bio-Ttds-LLWHTGDHSVSLFYEVLDYP-NH2 |
| 1154 | JBS-0619 | Bio-Ttds-DSTIYVGWYSYDHDYDIWGY-NH2 | 1189 | JBS-0654 | Bio-Ttds-LWMVRILRTDGAEVVVGWEL-NH2 |
| 1155 | JBS-0620 | Bio-Ttds-EHRHTRSKDPYYSVELMWEF-NH2 | 1190 | JBS-0655 | Bio-Ttds-MGLWYGWEYVNGLGGHEIEI-NH2 |
| 1156 | JBS-0621 | Bio-Ttds-EIEVGYETFESGEAVMWVAF-NH2 | 1191 | JBS-0656 | Bio-Ttds-NHVWEVQLDKSWIGWEWID-NH2 |
| 1157 | JBS-0622 | Bio-Ttds-ELVLVWESTDGRVQLWAQWD-NH2 | 1192 | JBS-0657 | Bio-Ttds-NSSNSNGQKFRYFIEVGWYH-NH2 |
| 1158 | JBS-0623 | Bio-Ttds-EVRWELGIESRFSGWYMVLG-NH2 | 1193 | JBS-0658 | Bio-Ttds-NTTGRIELWIQLPDRDWLLW-NH2 |
| 1159 | JBS-0624 | Bio-Ttds-EWQVTSTVWIGWELQMDLAT-NH2 | 1194 | JBS-0659 | Bio-Ttds-PYFVELGYEGYGVFYKIELL-NH2 |
| 1160 | JBS-0625 | Bio-Ttds-EYAWELGYWSMWDNTSWLQISTHV-NH2 | 1195 | JBS-0660 | Bio-Ttds-PYGVWYSWDNTSWLQISTHV-NH2 |
| 1161 | JBS-0626 | Bio-Ttds-FDVPLMAWSGEMYIEIGLH-NH2 | 1196 | JBS-0661 | Bio-Ttds-QFFGLISGDGRLQIWGWYE-NH2 |
| 1162 | JBS-0627 | Bio-Ttds-FGVVAVGYYDREYDKWTLIA-NH2 | 1197 | JBS-0662 | Bio-Ttds-QGKYGIVAWGWVPSGGHRYQ-NH2 |
| 1163 | JBS-0628 | Bio-Ttds-FIVVGAYSKLTGLHIQWGYE-NH2 | 1198 | JBS-0663 | Bio-Ttds-QIQWGYEYASGWQMWWERSN-NH2 |
| 1164 | JBS-0629 | Bio-Ttds-FSGSGPWFVYLIGGSIEMGY-NH2 | 1199 | JBS-0664 | Bio-Ttds-QVELMFEDRSTGQYRLATI-NH2 |
| 1165 | JBS-0630 | Bio-Ttds-FVSLMWETSNGRGEIARWII-NH2 | 1200 | JBS-0665 | Bio-Ttds-QVSSIELWAEYGDVPRLIWS-NH2 |
| 1166 | JBS-0631 | Bio-Ttds-GAAWFITLDGGIVEIGWEQI-NH2 | 1201 | JBS-0666 | Bio-Ttds-QWDWVEYEWGNTIGLVGWYE-NH2 |
| 1167 | JBS-0632 | Bio-Ttds-GFYWEVGFYDYGSDSINVHA-NH2 | 1202 | JBS-0667 | Bio-Ttds-QWRILGLHEMGTGYDLVLW-NH2 |
| 1168 | JBS-0633 | Bio-Ttds-GHSVEIGWYNNVAKDQPDMY-NH2 | 1203 | JBS-0668 | Bio-Ttds-RLIELGFWYEIAREHVVVWS-NH2 |
| 1169 | JBS-0634 | Bio-Ttds-GKYLLLDFFTWLTKEVGVGM-NH2 | 1204 | JBS-0669 | Bio-Ttds-RLIELGFWYEIAREHVVVWS-NH2 |
| 1170 | JBS-0635 | Bio-Ttds-GLGWEVGWHVLESSHDLTIH-NH2 | 1205 | JBS-0670 | Bio-Ttds-RRITILGWYVYSNNTYMIWTT-NH2 |
| 1171 | JBS-0636 | Bio-Ttds-GLIEWGWYSRQEDQHWLMGT-NH2 | 1206 | JBS-0671 | Bio-Ttds-RWIVYSHEVEISKGVWLGYE-NH2 |
| 1172 | JBS-0637 | Bio-Ttds-GRMLIGLAPQAEVWFLMQPM-NH2 | 1207 | JBS-0672 | Bio-Ttds-RYGYIVVGWYDFNKDLYTRF-NH2 |
| 1173 | JBS-0638 | Bio-Ttds-GTEIGWLDLLITDHVIWSVTI-NH2 | 1208 | JBS-0673 | Bio-Ttds-SGIILGMYSVYRNEWFEWGT-NH2 |
| 1174 | JBS-0639 | Bio-Ttds-GTQERGSKRMMFTVELMWEP-NH2 | 1209 | JBS-0674 | Bio-Ttds-SGRGTPAGDHKYSIEAFYYT-NH2 |
| 1175 | JBS-0640 | Bio-Ttds-GWFMEVATVLGVIEVGWVY-NH2 | 1210 | JBS-0675 | Bio-Ttds-SIRQRDQYTIELYWEWVDSP-NH2 |
| 1176 | JBS-0641 | Bio-Ttds-GWIFIGLHSYHIGMESEWPG-NH2 | 1211 | JBS-0676 | Bio-Ttds-SLIWSSNTSGRYVELWAER-NH2 |
| 1177 | JBS-0642 | Bio-Ttds-HLEYNGGTIYWGSEPFNASM-NH2 | 1212 | JBS-0677 | Bio-Ttds-SLSRSDEAKLLWRIEFGWEY-NH2 |
| 1178 | JBS-0643 | Bio-Ttds-HMRGTATSERRYWIEVGWFD-NH2 | 1213 | JBS-0678 | Bio-Ttds-SNKYRLVSDLQYTVEFGWEW-NH2 |
| 1179 | JBS-0644 | Bio-Ttds-HMTVEFGYYWEMDTNTVIW-NH2 | 1214 | JBS-0679 | Bio-Ttds-SQKPDETRMSRYSIELFWEL-NH2 |
| 1180 | JBS-0645 | Bio-Ttds-IEVGWYNVVTQKHSKLGMLI-NH2 | 1215 | JBS-0680 | Bio-Ttds-STIWLMTNGIVEVGWEFTDY-NH2 |
| 1181 | JBS-0646 | Bio-Ttds-ISVGWYFWATDNYKEFGNTL-NH2 | 1216 | JBS-0681 | Bio-Ttds-SVSVGWYYTVEERHYMLWLG-NH2 |
| 1182 | JBS-0647 | Bio-Ttds-KFKRWEIGFMLESGEEYVLA-NH2 | 1217 | JBS-0682 | Bio-Ttds-SVTVGWYSWIEDMEWTVYSQ-NH2 |

FIGURE 2P

| SEQ ID | Compound | Sequence | SEQ ID | Compound | Sequence |
| --- | --- | --- | --- | --- | --- |
| 1218 | JBS-0683 | Bio-Ttds-SWRVEIGWHWLISGIDEPTI-NH2 | 1259 | JBS-1069 | Ac-HLALWQRWPSPWVEVGWEFV-NH2 |
| 1219 | JBS-0685 | Bio-Ttds-TIVIGHLDRVSGVETDFYSV-NH2 | 1260 | JBS-1070 | Ac-HLYAWQRWPSPWVEVGWEFV-NH2 |
| 1220 | JBS-0686 | Bio-Ttds-TRRIGFSVQFGWEVSSQYTH-NH2 | 1261 | JBS-1071 | Ac-HLYLAQRWPSPWVEVGWEFV-NH2 |
| 1221 | JBS-0687 | Bio-Ttds-TVELWIWNIFTDHSHMIASI-NH2 | 1262 | JBS-1072 | Ac-HLYLWARWPSPWVEVGWEFV-NH2 |
| 1222 | JBS-0688 | Bio-Ttds-TYVYWEVGLESANGAKEIWQ-NH2 | 1263 | JBS-1073 | Ac-HLYLWQAWPSPWVEVGWEFV-NH2 |
| 1223 | JBS-0689 | Bio-Ttds-VEFGWYRRESDTWHSWGKVN-NH2 | 1264 | JBS-1074 | Ac-HLYLWQRAPSPWVEVGWEFV-NH2 |
| 1224 | JBS-0690 | Bio-Ttds-VEIGWHFLKYEKELVWYMHQ-NH2 | 1265 | JBS-1075 | Ac-HLYLWQRWASPWVEVGWEFV-NH2 |
| 1225 | JBS-0691 | Bio-Ttds-VEIGWHFLNYEKELVWYMHQ-NH2 | 1266 | JBS-1076 | Ac-HLYLWQRWPAPWVEVGWEFV-NH2 |
| 1226 | JBS-0692 | Bio-Ttds-VEVGWEQDGVTVTVTWHT-NH2 | 1267 | JBS-1077 | Ac-HLYLWQRWPSAWVEVGWEFV-NH2 |
| 1227 | JBS-0693 | Bio-Ttds-VEVGWVSLFKDLTVFKEWIP-NH2 | 1268 | JBS-1078 | Ac-HLYLWQRWPSPAEVGWEFV-NH2 |
| 1228 | JBS-0694 | Bio-Ttds-VFEVGWVTSDGRVLWRTIRN-NH2 | 1269 | JBS-1079 | Ac-HLYLWQRWPSPWAEVGWEFV-NH2 |
| 1229 | JBS-0695 | Bio-Ttds-VIWRDGRSLERWSIEFGWEA-NH2 | 1270 | JBS-1080 | Ac-HLYLWQRWPSPWVAVGWEFV-NH2 |
| 1230 | JBS-0696 | Bio-Ttds-VRPKEIRKRPLFYVELFWEH-NH2 | 1271 | JBS-1081 | Ac-HLYLWQRWPSPWVEAGWEFV-NH2 |
| 1231 | JBS-0697 | Bio-Ttds-VVEIGWVLVSSLGNERKVVLW-NH2 | 1272 | JBS-1082 | Ac-HLYLWQRWPSPWVEVAWEFV-NH2 |
| 1232 | JBS-0698 | Bio-Ttds-VYSVESGWYSFNDDEWMSFY-NH2 | 1273 | JBS-1083 | Ac-HLYLWQRWPSPWVEVGAEFV-NH2 |
| 1233 | JBS-0699 | Bio-Ttds-WEIELGLVMNGQEYMIVTLY-NH2 | 1274 | JBS-1084 | Ac-HLYLWQRWPSPWVEVGWAFV-NH2 |
| 1234 | JBS-0700 | Bio-Ttds-WEYWEVYTIGPVTVGWELIA-NH2 | 1275 | JBS-1085 | Ac-HLYLWQRWPSPWVEVGWEAV-NH2 |
| 1235 | JBS-0701 | Bio-Ttds-WGIMELGMYWYEDGRHKAIW-NH2 | 1276 | JBS-1086 | Ac-HLYLWQRWPSPWVEVGWEFA-NH2 |
| 1236 | JBS-0702 | Bio-Ttds-WGITLGWEDGHGNEHDFYVL-NH2 | 1277 | JBS-1087 | Ac-DLYLWQRWPSPWVEVGWEFV-NH2 |
| 1237 | JBS-0703 | Bio-Ttds-WGVVEVGYHFVATGSNEALM-NH2 | 1278 | JBS-1088 | Ac-HDYLWQRWPSPWVEVGWEFV-NH2 |
| 1238 | JBS-0704 | Bio-Ttds-WGMWIVSAGWHYSAMAEDHPW-NH2 | 1279 | JBS-1089 | Ac-HLDLWQRWPSPWVEVGWEFV-NH2 |
| 1239 | JBS-0705 | Bio-Ttds-WIFTWSSGDHIGVIEMGYES-NH2 | 1280 | JBS-1090 | Ac-HLYDWQRWPSPWVEVGWEFV-NH2 |
| 1240 | JBS-0706 | Bio-Ttds-WIVIGWEDAYGRSVIWYKVG-NH2 | 1281 | JBS-1091 | Ac-HLYLDQRWPSPWVEVGWEFV-NH2 |
| 1241 | JBS-0707 | Bio-Ttds-WKIIVGWELFDTGETTWWKV-NH2 | 1282 | JBS-1092 | Ac-HLYLWDRWPSPWVEVGWEFV-NH2 |
| 1242 | JBS-0708 | Bio-Ttds-WKWRTFDGSIEIGFVAVQWS-NH2 | 1283 | JBS-1093 | Ac-HLYLWQDWPSPWVEVGWEFV-NH2 |
| 1243 | JBS-0709 | Bio-Ttds-WLIEFGYMWNGENRTLAVWE-NH2 | 1284 | JBS-1094 | Ac-HLYLWQRDPSPWVEVGWEFV-NH2 |
| 1244 | JBS-0710 | Bio-Ttds-WRETIFYYTDQISVVILEKV-NH2 | 1285 | JBS-1095 | Ac-HLYLWQRMDSPWVEVGWEFV-NH2 |
| 1245 | JBS-0711 | Bio-Ttds-WSPGMKEIELGSTGIYWGWS-NH2 | 1286 | JBS-1096 | Ac-HLYLWQRWPDPWVEVGWEFV-NH2 |
| 1246 | JBS-0712 | Bio-Ttds-WWEFGYYDPETDESTILTEM-NH2 | 1287 | JBS-1097 | Ac-HLYLWQRWPSDWVEVGWEFV-NH2 |
| 1247 | JBS-0713 | Bio-Ttds-YSIVYGHYQKQTNTWTELVY-NH2 | 1288 | JBS-1098 | Ac-HLYLWQRWPSPDVEVGWEFV-NH2 |
| 1248 | JBS-0714 | Bio-Ttds-YTVEVGWHTVHTGRDNYMWM-NH2 | 1289 | JBS-1099 | Ac-HLYLWQRWPSPWDEVGWEFV-NH2 |
| 1249 | JBS-0715 | Bio-Ttds-YVEVGYYFHTTDNEVIYAN-NH2 | 1290 | JBS-1100 | Ac-HLYLWQRWPSPWVDVGWEFV-NH2 |
| 1250 | JBS-0716 | Bio-Ttds-YVEVGYYFYTTDNEVIYAN-NH2 | 1291 | JBS-1101 | Ac-HLYLWQRWPSPWVEDGWEFV-NH2 |
| 1251 | JBS-1027 | Ac-AFWEAGWYDSVGNSWNVFFK-NH2 | 1292 | JBS-1102 | Ac-HLYLWQRWPSPWVEVDWEFV-NH2 |
| 1252 | JBS-1028 | Ac-HLYLWQRWPSPWVEVGWEFV-NH2 | 1293 | JBS-1103 | Ac-HLYLWQRWPSPWVEVGDEFV-NH2 |
| 1253 | JBS-1047 | Ac-RPTTLIRLGANSWIEIGWEI-NH2 | 1294 | JBS-1104 | Ac-HLYLWQRWPSPWVEVGWDFV-NH2 |
| 1254 | JBS-1048 | Ac-YILWSVYVPGIEVGWTESA-NH2 | 1295 | JBS-1105 | Ac-HLYLWQRWPSPWVEVGWEDV-NH2 |
| 1255 | JBS-1049 | Ac-DLDPRIVLVGNGEIEIGWSI-NH2 | 1296 | JBS-1106 | Ac-HLYLWQRWPSPWVEVGWEFD-NH2 |
| 1256 | JBS-1050 | Ac-WKIIVGWELFDTGETTWWKV-NH2 | 1297 | JBS-1107 | Ac-FLYLWQRWPSPWVEVGWEFV-NH2 |
| 1257 | JBS-1067 | Ac-ALYLWQRWPSPWVEVGWEFV-NH2 | 1298 | JBS-1108 | Ac-HFYLWQRWPSPWVEVGWEFV-NH2 |
| 1258 | JBS-1068 | Ac-HAYLWQRWPSPWVEVGWEFV-NH2 | 1299 | JBS-1109 | Ac-HLFLWQRWPSPWVEVGWEFV-NH2 |

FIGURE 2Q

| SEQ ID | Compound | Sequence | SEQ ID | Compound | Sequence |
|---|---|---|---|---|---|
| 1300 | JBS-1110 | Ac-HLYLYFWQRWPSPWVEVGWEFV-NH2 | 1341 | JBS-1152 | Ac-HLYLMQKWPSPWVEVGWEFV-NH2 |
| 1301 | JBS-1111 | Ac-HLYLFQRWPSPWVEVGWEFV-NH2 | 1342 | JBS-1153 | Ac-HLYLMQRKPSPWVEVGWEFV-NH2 |
| 1302 | JBS-1112 | Ac-HLYLMFRWPSPWVEVGWEFV-NH2 | 1343 | JBS-1154 | Ac-HLYLMQRWKSPWVEVGWEFV-NH2 |
| 1303 | JBS-1113 | Ac-HLYLMQFWPSPWVEVGWEFV-NH2 | 1344 | JBS-1155 | Ac-HLYLMQRWPKPWVEVGWEFV-NH2 |
| 1304 | JBS-1114 | Ac-HLYLMQRFPSPWVEVGWEFV-NH2 | 1345 | JBS-1156 | Ac-HLYLMQRWPSKWVEVGWEFV-NH2 |
| 1305 | JBS-1115 | Ac-HLYLMQRWFPSPWVEVGWEFV-NH2 | 1346 | JBS-1157 | Ac-HLYLMQRWPSPKVEVGWEFV-NH2 |
| 1306 | JBS-1116 | Ac-HLYLMQRWPFPWVEVGWEFV-NH2 | 1347 | JBS-1158 | Ac-HLYLMQRWPSPWKEVGWEFV-NH2 |
| 1307 | JBS-1117 | Ac-HLYLMQRWPSFWVEVGWEFV-NH2 | 1348 | JBS-1159 | Ac-HLYLMQRWPSPWVKVGWEFV-NH2 |
| 1308 | JBS-1118 | Ac-HLYLMQRWPSPFVEVGWEFV-NH2 | 1349 | JBS-1160 | Ac-HLYLMQRWPSPWVEKGWEFV-NH2 |
| 1309 | JBS-1119 | Ac-HLYLMQRWPSPWFEVGWEFV-NH2 | 1350 | JBS-1161 | Ac-HLYLMQRWPSPWVEVKWEFV-NH2 |
| 1310 | JBS-1120 | Ac-HLYLMQRWPSPWVFVGWEFV-NH2 | 1351 | JBS-1162 | Ac-HLYLMQRWPSPWVEVGKEFV-NH2 |
| 1311 | JBS-1121 | Ac-HLYLMQRWPSPWVEFGWEFV-NH2 | 1352 | JBS-1163 | Ac-HLYLMQRWPSPWVEVGWKFV-NH2 |
| 1312 | JBS-1122 | Ac-HLYLMQRWPSPWVEVFWEFV-NH2 | 1353 | JBS-1164 | Ac-HLYLMQRWPSPWVEVGWEKV-NH2 |
| 1313 | JBS-1123 | Ac-HLYLMQRWPSPWVEVGFEFV-NH2 | 1354 | JBS-1165 | Ac-HLYLMQRWPSPWVEVGWEFK-NH2 |
| 1314 | JBS-1124 | Ac-HLYLMQRWPSPWVEVGWFFV-NH2 | 1355 | JBS-1166 | Ac-LLYLMQRWPSPWVEVGWEFV-NH2 |
| 1315 | JBS-1126 | Ac-HLYLMQRWPSPWVEVGWEFF-NH2 | 1356 | JBS-1167 | Ac-HLLLMQRWPSPWVEVGWEFV-NH2 |
| 1316 | JBS-1127 | Ac-GLYLMQRWPSPWVEVGWEFV-NH2 | 1357 | JBS-1168 | Ac-HLYLLQRWPSPWVEVGWEFV-NH2 |
| 1317 | JBS-1128 | Ac-HGYLMQRWPSPWVEVGWEFV-NH2 | 1358 | JBS-1169 | Ac-HLYLMLRWPSPWVEVGWEFV-NH2 |
| 1318 | JBS-1129 | Ac-HLGLMQRWPSPWVEVGWEFV-NH2 | 1359 | JBS-1170 | Ac-HLYLMQLWPSPWVEVGWEFV-NH2 |
| 1319 | JBS-1130 | Ac-HLYGMQRWPSPWVEVGWEFV-NH2 | 1360 | JBS-1171 | Ac-HLYLMQRLPSPWVEVGWEFV-NH2 |
| 1320 | JBS-1131 | Ac-HLYLGQRWPSPWVEVGWEFV-NH2 | 1361 | JBS-1172 | Ac-HLYLMQRWLSPWVEVGWEFV-NH2 |
| 1321 | JBS-1132 | Ac-HLYLMGRWPSPWVEVGWEFV-NH2 | 1362 | JBS-1173 | Ac-HLYLMQRWPLPWVEVGWEFV-NH2 |
| 1322 | JBS-1133 | Ac-HLYLMQGWPSPWVEVGWEFV-NH2 | 1363 | JBS-1174 | Ac-HLYLMQRWPSLWVEVGWEFV-NH2 |
| 1323 | JBS-1134 | Ac-HLYLMQRGPSPWVEVGWEFV-NH2 | 1364 | JBS-1175 | Ac-HLYLMQRWPSPLVEVGWEFV-NH2 |
| 1324 | JBS-1135 | Ac-HLYLMQRWGSPWVEVGWEFV-NH2 | 1365 | JBS-1176 | Ac-HLYLMQRWPSPWLEVGWEFV-NH2 |
| 1325 | JBS-1136 | Ac-HLYLGQRWPSPWVEVGWEFG-NH2 | 1366 | JBS-1177 | Ac-HLYLMQRWPSPWVLGWEFV-NH2 |
| 1326 | JBS-1137 | Ac-HLYLMQRWPSGWVEVGWEFV-NH2 | 1367 | JBS-1178 | Ac-HLYLMQRWPSPWVELGWEFV-NH2 |
| 1327 | JBS-1138 | Ac-HLYLMQRWPSPGVEVGWEFV-NH2 | 1368 | JBS-1179 | Ac-HLYLMQRWPSPWVEVLWEFV-NH2 |
| 1328 | JBS-1139 | Ac-HLYLMQRWPSPWGEVGWEFV-NH2 | 1369 | JBS-1180 | Ac-HLYLMQRWPSPWVEVGLEFV-NH2 |
| 1329 | JBS-1140 | Ac-HLYLMQRWPSPWVGVGWEFV-NH2 | 1370 | JBS-1181 | Ac-HLYLMQRWPSPWVEVGWLFV-NH2 |
| 1330 | JBS-1141 | Ac-HLYLMQRWPSPWVEGGWEFV-NH2 | 1371 | JBS-1182 | Ac-HLYLMQRWPSPWVEVGWELV-NH2 |
| 1331 | JBS-1142 | Ac-HLYLMQRWPSPWVEVGGEFV-NH2 | 1372 | JBS-1183 | Ac-HLYLMQRWPSPWVEVGWEFL-NH2 |
| 1332 | JBS-1143 | Ac-HLYLMQRWPSPWVEVGWGFV-NH2 | 1373 | JBS-1184 | Ac-SLYLMQRWPSPWVEVGWEFV-NH2 |
| 1333 | JBS-1144 | Ac-HLYLMQRWPSPWVEVGWEGV-NH2 | 1374 | JBS-1185 | Ac-HSYLMQRWPSPWVEVGWEFV-NH2 |
| 1334 | JBS-1145 | Ac-HLYLMQRWPSPWVEVGWEFG-NH2 | 1375 | JBS-1186 | Ac-HLSLMQRWPSPWVEVGWEFV-NH2 |
| 1335 | JBS-1146 | Ac-KLYLMQRWPSPWVEVGWEFV-NH2 | 1376 | JBS-1187 | Ac-HLYSMQRWPSPWVEVGWEFV-NH2 |
| 1336 | JBS-1147 | Ac-HKYLMQRWPSPWVEVGWEFV-NH2 | 1377 | JBS-1188 | Ac-HLYLSQRWPSPWVEVGWEFV-NH2 |
| 1337 | JBS-1148 | Ac-HLKLMQRWPSPWVEVGWEFV-NH2 | 1378 | JBS-1189 | Ac-HLYLMSRWPSPWVEVGWEFV-NH2 |
| 1338 | JBS-1149 | Ac-HLYKMQRWPSPWVEVGWEFV-NH2 | 1379 | JBS-1190 | Ac-HLYLMQSWPSPWVEVGWEFV-NH2 |
| 1339 | JBS-1150 | Ac-HLYLKQRWPSPWVEVGWEFV-NH2 | 1380 | JBS-1191 | Ac-HLYLMQRSPSPWVEVGWEFV-NH2 |
| 1340 | JBS-1151 | Ac-HLYLMKRWPSPWVEVGWEFV-NH2 | 1381 | JBS-1192 | Ac-HLYLMQRWKSSPWVEVGWEFV-NH2 |

FIGURE 2R

| SEQ ID | Compound | Sequence | SEQ ID | Compound | Sequence |
|---|---|---|---|---|---|
| 1382 | JBS-1193 | Ac-HLYLMQRWPSSWVEVGWEFV-NH2 | 1423 | JBS-1234 | Ac-RPTALLIRLGANSWIEIGWEI-NH2 |
| 1383 | JBS-1194 | Ac-HLYLMQRWPSPSVEVGWEFV-NH2 | 1424 | JBS-1235 | Ac-RPTTAIRLGANSWIEIGWEI-NH2 |
| 1384 | JBS-1195 | Ac-HLYLMQRWPSPWSEVGWEFV-NH2 | 1425 | JBS-1236 | Ac-RPTTLARLGANSWIEIGWEI-NH2 |
| 1385 | JBS-1196 | Ac-HLYLMQRWPSPWVSVGWEFV-NH2 | 1426 | JBS-1237 | Ac-RPTTLIALGANSWIEIGWEI-NH2 |
| 1386 | JBS-1197 | Ac-HLYLMQRWPSPWVESGWEFV-NH2 | 1427 | JBS-1238 | Ac-RPTTLIRAGANSWIEIGWEI-NH2 |
| 1387 | JBS-1198 | Ac-HLYLMQRWPSPWVEVSWEFV-NH2 | 1428 | JBS-1239 | Ac-RPTTLIRLAANSWIEIGWEI-NH2 |
| 1388 | JBS-1199 | Ac-HLYLMQRWPSPWVEVGSEFV-NH2 | 1429 | JBS-1241 | Ac-RPTTLIRLGAASWIEIGWEI-NH2 |
| 1389 | JBS-1200 | Ac-HLYLMQRWPSPWVEVGWSFV-NH2 | 1430 | JBS-1242 | Ac-RPTTLIRLGANAWIEIGWEI-NH2 |
| 1390 | JBS-1201 | Ac-HLYLMQRWPSPWVEVGWESV-NH2 | 1431 | JBS-1243 | Ac-RPTTLIRLGANSAIEIGWEI-NH2 |
| 1391 | JBS-1202 | Ac-HLYLMQRWPSPWVEVGWEFS-NH2 | 1432 | JBS-1244 | Ac-RPTTLIRLGANSWAEIGWEI-NH2 |
| 1392 | JBS-1203 | Ac-PLYLMQRWPSPWVEVGWEFV-NH2 | 1433 | JBS-1245 | Ac-RPTTLIRLGANSWIAIGWEI-NH2 |
| 1393 | JBS-1204 | Ac-HPYLMQRWPSPWVEVGWEFV-NH2 | 1434 | JBS-1246 | Ac-RPTTLIRLGANSWIEAGWEI-NH2 |
| 1394 | JBS-1205 | Ac-HLPLMQRWPSPWVEVGWEFV-NH2 | 1435 | JBS-1247 | Ac-RPTTLIRLGANSWIEIAWEI-NH2 |
| 1395 | JBS-1206 | Ac-HLYPMQRWPSPWVEVGWEFV-NH2 | 1436 | JBS-1248 | Ac-RPTTLIRLGANSWIEIGAEI-NH2 |
| 1396 | JBS-1207 | Ac-HLYLPQRWPSPWVEVGWEFV-NH2 | 1437 | JBS-1249 | Ac-RPTTLIRLGANSWIEIGWAI-NH2 |
| 1397 | JBS-1208 | Ac-HLYLMPRWPSPWVEVGWEFV-NH2 | 1438 | JBS-1250 | Ac-RPTTLIRLGANSWIEIGWEA-NH2 |
| 1398 | JBS-1209 | Ac-HLYLMQPWPSPWVEVGWEFV-NH2 | 1439 | JBS-1251 | Ac-DPTTLIRLGANSWIEIGWEI-NH2 |
| 1399 | JBS-1210 | Ac-HLYLMQRPPSPWVEVPWEFV-NH2 | 1440 | JBS-1252 | Ac-RDTTLIRLGANSWIEIGWEI-NH2 |
| 1400 | JBS-1211 | Ac-HLYLMQRWPPPWVEVGWEFV-NH2 | 1441 | JBS-1253 | Ac-RPDTLIRLGANSWIEIGWEI-NH2 |
| 1401 | JBS-1212 | Ac-HLYLMQRWPSPPVEVGWEFV-NH2 | 1442 | JBS-1254 | Ac-RPTDLIRLGANSWIEIGWEI-NH2 |
| 1402 | JBS-1213 | Ac-HLYLMQRWPSPWPEVGWEFV-NH2 | 1443 | JBS-1255 | Ac-RPTTDIRLGANSWIEIGWEI-NH2 |
| 1403 | JBS-1214 | Ac-HLYLMQRWPSPWVPVGWEFV-NH2 | 1444 | JBS-1256 | Ac-RPTTLDRLGANSWIEIGWEI-NH2 |
| 1404 | JBS-1215 | Ac-HLYLMQRWPSPWVEPGWEFV-NH2 | 1445 | JBS-1257 | Ac-RPTTLIDLGANSWIEIGWEI-NH2 |
| 1405 | JBS-1216 | Ac-HLYLMQRWPSPWVEVPWEFV-NH2 | 1446 | JBS-1258 | Ac-RPTTLIRDGANSWIEIGWEI-NH2 |
| 1406 | JBS-1217 | Ac-HLYLMQRWPSPWVEVGPEFV-NH2 | 1447 | JBS-1259 | Ac-RPTTLIRLDANSWIEIGWEI-NH2 |
| 1407 | JBS-1218 | Ac-HLYLMQRWPSPWVEVGWPFV-NH2 | 1448 | JBS-1260 | Ac-RPTTLIRLGDNSWIEIGWEI-NH2 |
| 1408 | JBS-1219 | Ac-HLYLMQRWPSPWVEVGWEPV-NH2 | 1449 | JBS-1261 | Ac-RPTTLIRLGADSWIEIGWEI-NH2 |
| 1409 | JBS-1220 | Ac-HLYLMQRWPSPWVEVGWEFP-NH2 | 1450 | JBS-1262 | Ac-RPTTLIRLGANDWIEIGWEI-NH2 |
| 1410 | JBS-1221 | Ac-HLYLMQRWPSPWVEVGW-NH2 | 1451 | JBS-1263 | Ac-RPTTLIRLGANSDIEIGWEI-NH2 |
| 1411 | JBS-1222 | Ac-HLYLMQRWPSPWVE-NH2 | 1452 | JBS-1264 | Ac-RPTTLIRLGANSWDEIGWEI-NH2 |
| 1412 | JBS-1223 | Ac-HLYLMQRWPSF-NH2 | 1453 | JBS-1265 | Ac-RPTTLIRLGANSWIDIGWEI-NH2 |
| 1413 | JBS-1224 | Ac-HLYLMQRW-NH2 | 1454 | JBS-1266 | Ac-RPTTLIRLGANSWIEDGWEI-NH2 |
| 1414 | JBS-1225 | Ac-LMQRWPSPWVEVGWEFV-NH2 | 1455 | JBS-1267 | Ac-RPTTLIRLGANSWIEIDWEI-NH2 |
| 1415 | JBS-1226 | Ac-RWPSPWVEVGWEFV-NH2 | 1456 | JBS-1268 | Ac-RPTTLIRLGANSWIEIGDEI-NH2 |
| 1416 | JBS-1227 | Ac-SPWVEVGWEFV-NH2 | 1457 | JBS-1269 | Ac-RPTTLIRLGANSWIEIGWDI-NH2 |
| 1417 | JBS-1228 | Ac-VEVGWEFV-NH2 | 1458 | JBS-1270 | Ac-RPTTLIRLGANSWIEIGWED-NH2 |
| 1418 | JBS-1229 | Ac-LMQRWPSPWVEVGW-NH2 | 1459 | JBS-1271 | Ac-FPTTLIRLGANSWIEIGWEI-NH2 |
| 1419 | JBS-1230 | Ac-RWPSPWVE-NH2 | 1460 | JBS-1272 | Ac-RFTTLIRLGANSWIEIGWEI-NH2 |
| 1420 | JBS-1231 | Ac-APTTLIRLGANSWIEIGWEI-NH2 | 1461 | JBS-1273 | Ac-RPFTLIRLGANSWIEIGWEI-NH2 |
| 1421 | JBS-1232 | Ac-RATTLIRLGANSWIEIGWEI-NH2 | 1462 | JBS-1274 | Ac-RPTFLIRLGANSWIEIGWEI-NH2 |
| 1422 | JBS-1233 | Ac-RPATLIRLGANSWIEIGWEI-NH2 | 1463 | JBS-1275 | Ac-RPTTFIRLGANSWIEIGWEI-NH2 |

FIGURE 2S

| SEQ ID | Compound | Sequence | SEQ ID | Compound | Sequence |
|---|---|---|---|---|---|
| 1464 | JBS-1276 | Ac-RPTTLFRLGANSWIEIGWEI-NH2 | 1505 | JBS-1317 | Ac-RPTTLIRLKANSWIEIGWEI-NH2 |
| 1465 | JBS-1277 | Ac-RPTTLIFLGANSWIEIGWEI-NH2 | 1506 | JBS-1318 | Ac-RPTTLIRLGKNSWIEIGWEI-NH2 |
| 1466 | JBS-1278 | Ac-RPTTLIRFGANSWIEIGWEI-NH2 | 1507 | JBS-1319 | Ac-RPTTLIRLGAKSWIEIGWEI-NH2 |
| 1467 | JBS-1279 | Ac-RPTTLIRLFANSWIEIGWEI-NH2 | 1508 | JBS-1320 | Ac-RPTTLIRLGANKWIEIGWEI-NH2 |
| 1468 | JBS-1280 | Ac-RPTTLIRLGFNSWIEIGWEI-NH2 | 1509 | JBS-1321 | Ac-RPTTLIRLGANSKIEIGWEI-NH2 |
| 1469 | JBS-1281 | Ac-RPTTLIRLGAFSWIEIGWEI-NH2 | 1510 | JBS-1322 | Ac-RPTTLIRLGANSWKEIGWEI-NH2 |
| 1470 | JBS-1282 | Ac-RPTTLIRLGANFWIEIGWEI-NH2 | 1511 | JBS-1323 | Ac-RPTTLIRLGANSWIKIGWEI-NH2 |
| 1471 | JBS-1283 | Ac-RPTTLIRLGANSFIEIGWEI-NH2 | 1512 | JBS-1324 | Ac-RPTTLIRLGANSWIEKGWEI-NH2 |
| 1472 | JBS-1284 | Ac-RPTTLIRLGANSWFEIGWEI-NH2 | 1513 | JBS-1325 | Ac-RPTTLIRLGANSWIEIKWEI-NH2 |
| 1473 | JBS-1285 | Ac-RPTTLIRLGANSWIFIGWEI-NH2 | 1514 | JBS-1326 | Ac-RPTTLIRLGANSWIEIGKEI-NH2 |
| 1474 | JBS-1286 | Ac-RPTTLIRLGANSWIEFGWEI-NH2 | 1515 | JBS-1327 | Ac-RPTTLIRLGANSWIEIGWKI-NH2 |
| 1475 | JBS-1287 | Ac-RPTTLIRLGANSWIEIFWEI-NH2 | 1516 | JBS-1328 | Ac-RPTTLIRLGANSWIEIGWEK-NH2 |
| 1476 | JBS-1288 | Ac-RPTTLIRLGANSWIEIGFEI-NH2 | 1517 | JBS-1329 | Ac-LPTTLIRLGANSWIEIGWEI-NH2 |
| 1477 | JBS-1289 | Ac-RPTTLIRLGANSWIEIGWFI-NH2 | 1518 | JBS-1330 | Ac-RLTTLIRLGANSWIEIGWEI-NH2 |
| 1478 | JBS-1290 | Ac-RPTTLIRLGANSWIEIGWEF-NH2 | 1519 | JBS-1331 | Ac-RPLTLIRLGANSWIEIGWEI-NH2 |
| 1479 | JBS-1291 | Ac-GPTTLIRLGANSWIEIGWEI-NH2 | 1520 | JBS-1332 | Ac-RPTLLIRLGANSWIEIGWEI-NH2 |
| 1480 | JBS-1292 | Ac-RGTTLIRLGANSWIEIGWEI-NH2 | 1521 | JBS-1333 | Ac-RPTTLLRLGANSWIEIGWEI-NH2 |
| 1481 | JBS-1293 | Ac-RPGTLIRLGANSWIEIGWEI-NH2 | 1522 | JBS-1334 | Ac-RPTTLIRLLANSWIEIGWEI-NH2 |
| 1482 | JBS-1294 | Ac-RPTGLIRLGANSWIEIGWEI-NH2 | 1523 | JBS-1335 | Ac-RPTTLIRLLANSWIEIGWEI-NH2 |
| 1483 | JBS-1295 | Ac-RPTTGIRLGANSWIEIGWEI-NH2 | 1524 | JBS-1336 | Ac-RPTTLIRLGLNSWIEIGWEI-NH2 |
| 1484 | JBS-1296 | Ac-RPTTLGRLGANSWIEIGWEI-NH2 | 1525 | JBS-1337 | Ac-RPTTLIRLGALSWIEIGWEI-NH2 |
| 1485 | JBS-1297 | Ac-RPTTLIGLGANSWIEIGWEI-NH2 | 1526 | JBS-1338 | Ac-RPTTLIRLGANLWIEIGWEI-NH2 |
| 1486 | JBS-1298 | Ac-RPTTLIRGGANSWIEIGWEI-NH2 | 1527 | JBS-1339 | Ac-RPTTLIRLGANSLIEIGWEI-NH2 |
| 1487 | JBS-1299 | Ac-RPTTLIRLGGNSWIEIGWEI-NH2 | 1528 | JBS-1340 | Ac-RPTTLIRLGANSWLEIGWEI-NH2 |
| 1488 | JBS-1300 | Ac-RPTTLIRLGAGSWIEIGWEI-NH2 | 1529 | JBS-1341 | Ac-RPTTLIRLGANSWILIGWEI-NH2 |
| 1489 | JBS-1301 | Ac-RPTTLIRLGANGWIEIGWEI-NH2 | 1530 | JBS-1342 | Ac-RPTTLIRLGANSWIELGWEI-NH2 |
| 1490 | JBS-1302 | Ac-RPTTLIRLGANSGIEIGWEI-NH2 | 1531 | JBS-1343 | Ac-RPTTLIRLGANSWIEILWEI-NH2 |
| 1491 | JBS-1303 | Ac-RPTTLIRLGANSWGEIGWEI-NH2 | 1532 | JBS-1344 | Ac-RPTTLIRLGANSWIEIGLEI-NH2 |
| 1492 | JBS-1304 | Ac-RPTTLIRLGANSWIGIGWEI-NH2 | 1533 | JBS-1345 | Ac-RPTTLIRLGANSWIEIGWLI-NH2 |
| 1493 | JBS-1305 | Ac-RPTTLIRLGANSWIEGGWEI-NH2 | 1534 | JBS-1346 | Ac-RPTTLIRLGANSWIEIGWEL-NH2 |
| 1494 | JBS-1306 | Ac-RPTTLIRLGANSWIEIGGEI-NH2 | 1535 | JBS-1347 | Ac-SPTTLIRLGANSWIEIGWEI-NH2 |
| 1495 | JBS-1307 | Ac-RPTTLIRLGANSWIEIGWGI-NH2 | 1536 | JBS-1348 | Ac-RSTTLIRLGANSWIEIGWEI-NH2 |
| 1496 | JBS-1308 | Ac-RPTTLIRLGANSWIEIGWEG-NH2 | 1537 | JBS-1349 | Ac-RPSTLIRLGANSWIEIGWEI-NH2 |
| 1497 | JBS-1309 | Ac-KPTTLIRLGANSWIEIGWEI-NH2 | 1538 | JBS-1350 | Ac-RPTSLIRLGANSWIEIGWEI-NH2 |
| 1498 | JBS-1310 | Ac-RKTTLIRLGANSWIEIGWEI-NH2 | 1539 | JBS-1351 | Ac-RPTTSIRLGANSWIEIGWEI-NH2 |
| 1499 | JBS-1311 | Ac-RPKTLIRLGANSWIEIGWEI-NH2 | 1540 | JBS-1352 | Ac-RPTTLSRLGANSWIEIGWEI-NH2 |
| 1500 | JBS-1312 | Ac-RPTKLIRLGANSWIEIGWEI-NH2 | 1541 | JBS-1353 | Ac-RPTTLISLGANSWIEIGWEI-NH2 |
| 1501 | JBS-1313 | Ac-RPTTLKRLGANSWIEIGWEI-NH2 | 1542 | JBS-1354 | Ac-RPTTLIRSGANSWIEIGWEI-NH2 |
| 1502 | JBS-1314 | Ac-RPTTLIKLGANSWIEIGWEI-NH2 | 1543 | JBS-1355 | Ac-RPTTLIRLSANSWIEIGWEI-NH2 |
| 1503 | JBS-1315 | Ac-RPTTLIRKGANSWIEIGWEI-NH2 | 1544 | JBS-1356 | Ac-RPTTLIRLGSNSWIEIGWEI-NH2 |
| 1504 | JBS-1316 | Ac-RPTTLIRLKANSWIEIGWEI-NH2 | 1545 | JBS-1357 | Ac-RPTTLIRLGASSWIEIGWEI-NH2 |

FIGURE 2T

| SEQ ID | Compound | Sequence | SEQ ID | Compound | Sequence |
| --- | --- | --- | --- | --- | --- |
| 1546 | JBS-1358 | Ac-RPTTLIRLGANSSIEIGWEI-NH2 | 1587 | JBS-1399 | Ac-WKIIAGWELFDTGETTWWKV-NH2 |
| 1547 | JBS-1359 | Ac-RPTTLIRLGANSWSEIGWEI-NH2 | 1588 | JBS-1400 | Ac-WKIIVAWELFDTGETTWWKV-NH2 |
| 1548 | JBS-1360 | Ac-RPTTLIRLGANSWISIGWEI-NH2 | 1589 | JBS-1401 | Ac-WKIIVGAELFDTGETTWWKV-NH2 |
| 1549 | JBS-1361 | Ac-RPTTLIRLGANSWIESGWEI-NH2 | 1590 | JBS-1402 | Ac-WKIIVGWALFDTGETTWWKV-NH2 |
| 1550 | JBS-1362 | Ac-RPTTLIRLGANSWIEISWEI-NH2 | 1591 | JBS-1403 | Ac-WKIIVGWEAFDTGETTWWKV-NH2 |
| 1551 | JBS-1363 | Ac-RPTTLIRLGANSWIEIGSEI-NH2 | 1592 | JBS-1404 | Ac-WKIIVGWELADTGETTWWKV-NH2 |
| 1552 | JBS-1364 | Ac-RPTTLIRLGANSWIEIGWSI-NH2 | 1593 | JBS-1405 | Ac-WKIIVGWELFATGETTWWKV-NH2 |
| 1553 | JBS-1365 | Ac-RPTTLIRLGANSWIEIGWES-NH2 | 1594 | JBS-1406 | Ac-WKIIVGWELFDAGETTWWKV-NH2 |
| 1554 | JBS-1366 | Ac-PPTTLIRLGANSWIEIGWEI-NH2 | 1595 | JBS-1407 | Ac-WKIIVGWELFDTAETTWWKV-NH2 |
| 1555 | JBS-1367 | Ac-RPPTLIRLGANSWIEIGWEI-NH2 | 1596 | JBS-1408 | Ac-WKIIVGWELFDTGATTWWKV-NH2 |
| 1556 | JBS-1368 | Ac-RPTPLIRLGANSWIEIGWEI-NH2 | 1597 | JBS-1409 | Ac-WKIIVGWELFDTGEATWWKV-NH2 |
| 1557 | JBS-1369 | Ac-RPTTPIRLGANSWIEIGWEI-NH2 | 1598 | JBS-1410 | Ac-WKIIVGWELFDTGETAWWKV-NH2 |
| 1558 | JBS-1370 | Ac-RPTTLPRLGANSWIEIGWEI-NH2 | 1599 | JBS-1411 | Ac-WKIIVGWELFDTGETTAWKV-NH2 |
| 1559 | JBS-1371 | Ac-RPTTLIPLGANSWIEIGWEI-NH2 | 1600 | JBS-1412 | Ac-WKIIVGWELFDTGETTWAKV-NH2 |
| 1560 | JBS-1372 | Ac-RPTTLIRPGANSWIEIGWEI-NH2 | 1601 | JBS-1413 | Ac-WKIIVGWELFDTGETTWWAV-NH2 |
| 1561 | JBS-1373 | Ac-RPTTLIRLPANSWIEIGWEI-NH2 | 1602 | JBS-1414 | Ac-WKIIVGWELFDTGETTWWKA-NH2 |
| 1562 | JBS-1374 | Ac-RPTTLIRLGPNSWIEIGWEI-NH2 | 1603 | JBS-1415 | Ac-DKIIVGWELFDTGETTWWKV-NH2 |
| 1563 | JBS-1375 | Ac-RPTTLIRLGAPSWIEIGWEI-NH2 | 1604 | JBS-1416 | Ac-WDIIVGWELFDTGETTWWKV-NH2 |
| 1564 | JBS-1376 | Ac-RPTTLIRLGANPWIEIGWEI-NH2 | 1605 | JBS-1417 | Ac-WKDIVGWELFDTGETTWWKV-NH2 |
| 1565 | JBS-1377 | Ac-RPTTLIRLGANSPIEIGWEI-NH2 | 1606 | JBS-1418 | Ac-WKIDVGWELFDTGETTWWKV-NH2 |
| 1566 | JBS-1378 | Ac-RPTTLIRLGANSWPEIGWEI-NH2 | 1607 | JBS-1419 | Ac-WKIIDGWELFDTGETTWWKV-NH2 |
| 1567 | JBS-1379 | Ac-RPTTLIRLGANSWIPIGWEI-NH2 | 1608 | JBS-1420 | Ac-WKIIVDWELFDTGETTWWKV-NH2 |
| 1568 | JBS-1380 | Ac-RPTTLIRLGANSWIEPGWEI-NH2 | 1609 | JBS-1421 | Ac-WKIIVGDELFDTGETTWWKV-NH2 |
| 1569 | JBS-1381 | Ac-RPTTLIRLGANSWIEIPWEI-NH2 | 1610 | JBS-1422 | Ac-WKIIVGWDLFDTGETTWWKV-NH2 |
| 1570 | JBS-1382 | Ac-RPTTLIRLGANSWIEIGPEI-NH2 | 1611 | JBS-1423 | Ac-WKIIVGWEDFDTGETTWWKV-NH2 |
| 1571 | JBS-1383 | Ac-RPTTLIRLGANSWIEIGWPI-NH2 | 1612 | JBS-1424 | Ac-WKIIVGWELDDTGETTWWKV-NH2 |
| 1572 | JBS-1384 | Ac-RPTTLIRLGANSWIEIGWEP-NH2 | 1613 | JBS-1426 | Ac-WKIIVGWELFDDGETTWWKV-NH2 |
| 1573 | JBS-1385 | Ac-RPTTLIRLGANSWIEIG-NH2 | 1614 | JBS-1427 | Ac-WKIIVGWELFDTDETTWWKV-NH2 |
| 1574 | JBS-1386 | Ac-RPTTLIRLGANSWI-NH2 | 1615 | JBS-1428 | Ac-WKIIVGWELFDTGDTTWWKV-NH2 |
| 1575 | JBS-1387 | Ac-RPTTLIRLGAN-NH2 | 1616 | JBS-1429 | Ac-WKIIVGWELFDTGEDTWWKV-NH2 |
| 1576 | JBS-1388 | Ac-RPTTLIRL-NH2 | 1617 | JBS-1430 | Ac-WKIIVGWELFDTGETDWWKV-NH2 |
| 1577 | JBS-1389 | Ac-TLIRLGANSWIEIGWEI-NH2 | 1618 | JBS-1431 | Ac-WKIIVGWELFDTGETTDWKV-NH2 |
| 1578 | JBS-1390 | Ac-RLGANSWIEIGWEI-NH2 | 1619 | JBS-1432 | Ac-WKIIVGWELFDTGETTWDKV-NH2 |
| 1579 | JBS-1391 | Ac-ANSWIEIGWEI-NH2 | 1620 | JBS-1433 | Ac-WKIIVGWELFDTGETTWWDV-NH2 |
| 1580 | JBS-1392 | Ac-WIEIGWEI-NH2 | 1621 | JBS-1434 | Ac-WKIIVGWELFDTGETTWWKD-NH2 |
| 1581 | JBS-1393 | Ac-TLIRLGANSWIEIG-NH2 | 1622 | JBS-1435 | Ac-FKIIVGWELFDTGETTWWKV-NH2 |
| 1582 | JBS-1394 | Ac-RLGANSWI-NH2 | 1623 | JBS-1436 | Ac-WFIIVGWELFDTGETTWWKV-NH2 |
| 1583 | JBS-1395 | Ac-AKIIVGWELFDTGETTWWKV-NH2 | 1624 | JBS-1437 | Ac-WKFIVGWELFDTGETTWWKV-NH2 |
| 1584 | JBS-1396 | Ac-WAIIVGWELFDTGETTWWKV-NH2 | 1625 | JBS-1438 | Ac-WKIFVGWELFDTGETTWDKV-NH2 |
| 1585 | JBS-1397 | Ac-WKAIVGWELFDTGETTWWKV-NH2 | 1626 | JBS-1439 | Ac-WKIIFGWELFDTGETTWWKV-NH2 |
| 1586 | JBS-1398 | Ac-WKIAVGWELFDTGETTWWKV-NH2 | 1627 | JBS-1440 | Ac-WKIIVFWELFDTGETTWWKV-NH2 |

FIGURE 2U

| SEQ ID | Compound | Sequence | SEQ ID | Compound | Sequence |
|---|---|---|---|---|---|
| 1628 | JBS-1441 | Ac-WKIIVGFELFDTGETTWWKV-NH2 | 1669 | JBS-1482 | Ac-WKIIVGWELFDKGETTWWKV-NH2 |
| 1629 | JBS-1442 | Ac-WKIIVGWELFDTGETTWWKV-NH2 | 1670 | JBS-1483 | Ac-WKIIVGWELFDTKETTWWKV-NH2 |
| 1630 | JBS-1443 | Ac-WKIIVGWEFFDTGETTWWKV-NH2 | 1671 | JBS-1484 | Ac-WKIIVGWELFDTGKTTWWKV-NH2 |
| 1631 | JBS-1444 | Ac-WKIIVGWELFFTGETTWWKV-NH2 | 1672 | JBS-1485 | Ac-WKIIVGWELFDTGEKTTWWKV-NH2 |
| 1632 | JBS-1445 | Ac-WKIIVGWELFDFGETTWWKV-NH2 | 1673 | JBS-1486 | Ac-WKIIVGWELFDTGETKWWKV-NH2 |
| 1633 | JBS-1446 | Ac-WKIIVGWELFDTFETTWWKV-NH2 | 1674 | JBS-1487 | Ac-WKIIVGWELFDTGETTKWKV-NH2 |
| 1634 | JBS-1447 | Ac-WKIIVGWELFDTGFTTWWKV-NH2 | 1675 | JBS-1488 | Ac-WKIIVGWELFDTGETTWKKV-NH2 |
| 1635 | JBS-1448 | Ac-WKIIVGWELFDTGEIFWWKV-NH2 | 1676 | JBS-1489 | Ac-WKIIVGWELFDTGETTWWKK-NH2 |
| 1636 | JBS-1449 | Ac-WKIIVGWELFDTGETFWWKV-NH2 | 1677 | JBS-1490 | Ac-LKIIVGWELFDTGETTWWKV-NH2 |
| 1637 | JBS-1450 | Ac-WKIIVGWELFDTGETTFWKV-NH2 | 1678 | JBS-1491 | Ac-WLIIVGWELFDTGETTWWKV-NH2 |
| 1638 | JBS-1451 | Ac-WKIIVGWELFDTGETTWFKV-NH2 | 1679 | JBS-1492 | Ac-WKLIVGWELFDTGETTWWKV-NH2 |
| 1639 | JBS-1452 | Ac-WKIIVGWELFDTGETTWWFV-NH2 | 1680 | JBS-1493 | Ac-WKILVGWELFDTGETTWWKV-NH2 |
| 1640 | JBS-1453 | Ac-WKIIVGWELFDTGETTWWKF-NH2 | 1681 | JBS-1494 | Ac-WKIILGWELFDTGETTWWKV-NH2 |
| 1641 | JBS-1454 | Ac-GKIIVGWELFDTGETTWWKV-NH2 | 1682 | JBS-1495 | Ac-WKIIVLWELFDTGETTWWKV-NH2 |
| 1642 | JBS-1455 | Ac-WGIIVGWELGDTGETTWWKV-NH2 | 1683 | JBS-1496 | Ac-WKIIVGLELFDTGETTWWKV-NH2 |
| 1643 | JBS-1456 | Ac-WKGIVGWELFDTGETTWWKV-NH2 | 1684 | JBS-1497 | Ac-WKIIVGWLLDTGETTWWKV-NH2 |
| 1644 | JBS-1457 | Ac-WKGVGWELFDTGETTWWKV-NH2 | 1685 | JBS-1498 | Ac-WKIIVGWELLDTGETTWWKV-NH2 |
| 1645 | JBS-1458 | Ac-WKIIGGWELFDTGETTWWKV-NH2 | 1686 | JBS-1499 | Ac-WKIIVGWELFLTGETTWWKV-NH2 |
| 1646 | JBS-1459 | Ac-WKIIVGGELFDTGETTWWKV-NH2 | 1687 | JBS-1500 | Ac-WKIIVGWELFDLGETTWWKV-NH2 |
| 1647 | JBS-1460 | Ac-WKIIVGWLFDTGETTWWKV-NH2 | 1688 | JBS-1501 | Ac-WKIIVGWELFDTLETTWWKV-NH2 |
| 1648 | JBS-1461 | Ac-WKIIVGWEGFDTGETTWWKV-NH2 | 1689 | JBS-1502 | Ac-WKIIVGWELFDTGLTTWWKV-NH2 |
| 1649 | JBS-1462 | Ac-WKIIVGWELGDTGETTWWKV-NH2 | 1690 | JBS-1503 | Ac-WKIIVGWELFDTGELTWWKV-NH2 |
| 1650 | JBS-1463 | Ac-WKIIVGWELFGTGETTWWKV-NH2 | 1691 | JBS-1504 | Ac-WKIIVGWELFDTGETLWWKV-NH2 |
| 1651 | JBS-1464 | Ac-WKIIVGWELFDGGETTWWKV-NH2 | 1692 | JBS-1505 | Ac-WKIIVGWELFDTGETTLWKV-NH2 |
| 1652 | JBS-1465 | Ac-WKIIVGWELFDTGGTTWWKV-NH2 | 1693 | JBS-1506 | Ac-WKIIVGWELFDTGETTWLKV-NH2 |
| 1653 | JBS-1466 | Ac-WKIIVGWELFDTGEGTWWKV-NH2 | 1694 | JBS-1507 | Ac-WKIIVGWELFDTGETTWWLV-NH2 |
| 1654 | JBS-1467 | Ac-WKIIVGWELFDTGETGWWKV-NH2 | 1695 | JBS-1508 | Ac-WKIIVSWELFDTGETTWWKL-NH2 |
| 1655 | JBS-1468 | Ac-WKIIVGWELFDTGETTGWKV-NH2 | 1696 | JBS-1509 | Ac-WKIIVGWELFDTGETTWWKV-NH2 |
| 1656 | JBS-1469 | Ac-WKIIVGWELFDTGETTWGKV-NH2 | 1697 | JBS-1510 | Ac-SKIIVGWELFDTGETTWWKV-NH2 |
| 1657 | JBS-1470 | Ac-WKIIVGWELFDTGETTWWGV-NH2 | 1698 | JBS-1511 | Ac-WSIIVGWELFDTGETTWWKV-NH2 |
| 1658 | JBS-1471 | Ac-WKIIVGWELFDTGETTWWKG-NH2 | 1699 | JBS-1512 | Ac-WKSIVGWELFDTGETTWWKV-NH2 |
| 1659 | JBS-1472 | Ac-RKIIVGWELFDTGETTWWKV-NH2 | 1700 | JBS-1513 | Ac-WKISVGWELFDTGETTWWKV-NH2 |
| 1660 | JBS-1473 | Ac-WKIIVGWEKFDTGETTWWKV-NH2 | 1701 | JBS-1514 | Ac-WKIISGWELFDTGETTWWKV-NH2 |
| 1661 | JBS-1474 | Ac-WKIIVSWELFDTGETTWWKV-NH2 | 1702 | JBS-1515 | Ac-WKIIVSWELFDTGETTWWKV-NH2 |
| 1662 | JBS-1475 | Ac-WKIIKGWELFDTGETTWWKV-NH2 | 1703 | JBS-1516 | Ac-WKIIVGSELFDTGETTWWKV-NH2 |
| 1663 | JBS-1476 | Ac-WKIIVKWELFDTGETTWWKV-NH2 | 1704 | JBS-1517 | Ac-WKIIVGWESFDTGETTWWKV-NH2 |
| 1664 | JBS-1477 | Ac-WKGKELFDTGETTWWKG-NH2 | 1705 | JBS-1518 | Ac-WKIIVGWELSDTGETTWWKV-NH2 |
| 1665 | JBS-1478 | Ac-WKIIVGWELKDTGETTWWKV-NH2 | 1706 | JBS-1519 | Ac-WKIIVGWELFSTGETTWWKV-NH2 |
| 1666 | JBS-1479 | Ac-WKIIVGWELFKTGETTWWKV-NH2 | 1707 | JBS-1520 | Ac-WKIIVGWELFDSGETTWWKV-NH2 |
| 1667 | JBS-1480 | Ac-WKIIVGWELKDTGETTWWKV-NH2 | 1708 | JBS-1521 | Ac-WKIIVGWELFDTSETTWWKV-NH2 |
| 1668 | JBS-1481 | Ac-WKIIVGWELFKTGETTWWKV-NH2 | 1709 | JBS-1522 | Ac-WKIIVGWELFDTGSTTWWKV-NH2 |

FIGURE 2V

| SEQ ID | Compound | Sequence | SEQ ID | Compound | Sequence |
| --- | --- | --- | --- | --- | --- |
| 1710 | JBS-1523 | Ac-WKIIVGWELFDTGESTWWKV-NH2 | 1751 | JBS-1565 | Ac-PATGLIINSETRGIRLIWNE-NH2 |
| 1711 | JBS-1524 | Ac-WKIIVGWELFDTGETSWWKV-NH2 | 1752 | JBS-1567 | Ac-TSGSAWGWEIPVVEYGIVYL-NH2 |
| 1712 | JBS-1525 | Ac-WKIIVGWELFDTGETTCWKV-NH2 | 1753 | JBS-1568 | Ac-VAYVWTLYVGISEEPGIGW-NH2 |
| 1713 | JBS-1526 | Ac-WKIIVGWELFDTGETTWSKV-NH2 | 1754 | JBS-1569 | Ac-TGIVLGWTDIKTEFVWWK-NH2 |
| 1714 | JBS-1527 | Ac-WKIIVGWELFDTGETTWWSV-NH2 | 1755 | JBS-1570 | Ac-KWLWTKGWVDIFVIIIGWE-NH2 |
| 1715 | JBS-1528 | Ac-WKIIVGWELFDTGETTWWKS-NH2 | 1756 | JBS-1572 | Ac-LDGISLGGPVIWVNIEDIER-NH2 |
| 1716 | JBS-1529 | Ac-PKIIVGWELFDTGETTWWKV-NH2 | 1757 | JBS-1573 | Ac-CLVIIEPDLIVDSGGWENRI-NH2 |
| 1717 | JBS-1530 | Ac-WPIIVGWELFDTGETTWWKV-NH2 | 1758 | JBS-1587 | Bio-Ttds-GQIEWGFYDHTTNQYWSMDV-NH2 |
| 1718 | JBS-1531 | Ac-WKPIVGWELFDTGETTWWKV-NH2 | 1759 | JBS-1588 | Bio-Ttds-LHELGRIQTEQYSIEIYYVH-NH2 |
| 1719 | JBS-1532 | Ac-WKIPVGWELFDTGETTWWKV-NH2 | 1760 | JBS-1589 | Bio-Ttds-HRIEIWWYNSGTNKHGLVHT-NH2 |
| 1720 | JBS-1533 | Ac-WKIIPGWELFDTGETTWWKV-NH2 | 1761 | JBS-1590 | Bio-Ttds-GRHTNDINKMRRAVQALFEN-NH2 |
| 1721 | JBS-1534 | Ac-WKIIVPWELFDTGETTWWKV-NH2 | 1762 | JBS-1591 | Bio-Ttds-WGLGFYDVITWRHTPIAFKT-NH2 |
| 1722 | JBS-1535 | Ac-WKIIVGPELFDTGETTWWKV-NH2 | 1763 | JBS-1592 | Bio-Ttds-VWISLGWYDMVNDRHSSLIM-NH2 |
| 1723 | JBS-1536 | Ac-WKIIVGWPLFDTGETTWWKV-NH2 | 1764 | JBS-1593 | Bio-Ttds-RKEYEWAEREGWKTTLSMFL-NH2 |
| 1724 | JBS-1537 | Ac-WKIIVGWEPFDTGETTWWKV-NH2 | 1765 | JBS-1594 | Bio-Ttds-AYMMMIGMYTELDTHKVVA-NH2 |
| 1725 | JBS-1538 | Ac-WKIIVGWELPDTGETTWWKV-NH2 | 1766 | JBS-1595 | Bio-Ttds-IVNSSVDWGYEMYASQWRHN-NH2 |
| 1726 | JBS-1539 | Ac-WKIIVGWELFPTGETTWWKV-NH2 | 1767 | JBS-1596 | Bio-Ttds-HVHLTYQIEVGWEYVKEIYK-NH2 |
| 1727 | JBS-1540 | Ac-WKIIVGWELFDPGETTWWKV-NH2 | 1768 | JBS-1597 | Bio-Ttds-RLRIELGVIVDGQVLIWKVL-NH2 |
| 1728 | JBS-1541 | Ac-WKIIVGWELFDTPETTWWKV-NH2 | 1769 | JBS-1598 | Bio-Ttds-HGVEVGFWDTVMDKVYIVHM-NH2 |
| 1729 | JBS-1542 | Ac-WKIIVGWELFDTGPTTWWKV-NH2 | 1770 | JBS-1599 | Bio-Ttds-IWVGYFNYEDIYWSQIGSMT-NH2 |
| 1730 | JBS-1543 | Ac-WKIIVGWELFDTGEPTWWKV-NH2 | 1771 | JBS-1600 | Bio-Ttds-SHRWRRLRELKWYVEFGWEV-NH2 |
| 1731 | JBS-1544 | Ac-WKIIVGWELFDTGETPWWKV-NH2 | 1772 | JBS-1601 | Bio-Ttds-YEWVDRAGMALFTLRDFYA-NH2 |
| 1732 | JBS-1545 | Ac-WKIIVGWELFDTGETTPWKV-NH2 | 1773 | JBS-1602 | Bio-Ttds-IFTVELWDSTQGEGMIWSI-NH2 |
| 1733 | JBS-1546 | Ac-WKIIVGWELFDTGETTWPKV-NH2 | 1774 | JBS-1603 | Bio-Ttds-WVSLGWYDSRSVNEQWYSVW-NH2 |
| 1734 | JBS-1547 | Ac-WKIIVGWELFDTGETTWWPV-NH2 | 1775 | JBS-1604 | Bio-Ttds-LMVFRRHSDKNGIYEVGYEV-NH2 |
| 1735 | JBS-1548 | Ac-WKIIVGWELFDTGETTWWKP-NH2 | 1776 | JBS-1605 | Bio-Ttds-GVTAGHYYIDINTYKPFESG-NH2 |
| 1736 | JBS-1549 | Ac-WKIIVGWELFDTGETTW-NH2 | 1777 | JBS-1606 | Bio-Ttds-WLVVRVNQISVWWDVGFTT-NH2 |
| 1737 | JBS-1550 | Ac-WKIIVGWELFDTGE-NH2 | 1778 | JBS-1607 | Bio-Ttds-EDPWEWQVWISVNGTEIRLH-NH2 |
| 1738 | JBS-1551 | Ac-WKIIVGWELFDTGE-NH2 | 1779 | JBS-1608 | Bio-Ttds-WRFWHAHENSGFLVEIGYER-NH2 |
| 1739 | JBS-1552 | Ac-WKIIVGWE-NH2 | 1780 | JBS-1609 | Bio-Ttds-EKTIEVGLYFKKEDVYKPMG-NH2 |
| 1740 | JBS-1553 | Ac-IVGWELFDTGETTWWKV-NH2 | 1781 | JBS-1610 | Bio-Ttds-KLIRVGFYNLNTNTHTYWED-NH2 |
| 1741 | JBS-1554 | Ac-WELFDTGETTWWKV-NH2 | 1782 | JBS-1611 | Bio-Ttds-SIVIMGFYNYNSDTYKLWSM-NH2 |
| 1742 | JBS-1555 | Ac-FDTGETTWWKV-NH2 | 1864 | JBS-1693 | Ac-VYEVGWDHGNWYEIIARYPS-NH2 |
| 1743 | JBS-1556 | Ac-GETTWWKV-NH2 | 1865 | JBS-1694 | Ac-VYEVGWDHGNWYEIIWAYPS-NH2 |
| 1744 | JBS-1557 | Ac-IVGWELFDIGETTW-NH2 | 1866 | JBS-1695 | Ac-VYEVGWDHGNWYEIIWRAPS-NH2 |
| 1745 | JBS-1558 | Ac-WELFDTGE-NH2 | 1867 | JBS-1696 | Ac-VYEVGWDHGNWYEIIWRYAS-NH2 |
| 1746 | JBS-1560 | Ac-DFGNENKWGSVWAVSFAFWY-NH2 | 1868 | JBS-1697 | Ac-VYEVGWDHGNWYEIIWRYPA-NH2 |
| 1747 | JBS-1561 | Ac-VFANGKSGWWFYNFEWDVAS-NH2 | 1869 | JBS-1698 | Ac-DYEVGWDHGNWYEIIWRYPS-NH2 |
| 1748 | JBS-1562 | Ac-WLELYSVVFRPPEQGWHVWW-NH2 | 1870 | JBS-1699 | Ac-VDEVGWDHGNWYEIIWRYPS-NH2 |
| 1749 | JBS-1563 | Ac-WHQSEYPVVFGLWPREWWLV-NH2 | 1871 | JBS-1700 | Ac-VYDVGWDHGNWYEIIWRYPS-NH2 |
| 1750 | JBS-1564 | Ac-GGLITTWNIEWELRRIIAPS-NH2 | 1872 | JBS-1701 | Ac-VYEDGWDHGNWYEIIWRYPS-NH2 |

| SEQ ID | Compound | Sequence | SEQ ID | Compound | Sequence |
|---|---|---|---|---|---|
| 1873 | JBS-1702 | Ac-VYEVDWDHGNWYEIIWRYPS-NH2 | 1914 | JBS-1743 | Ac-VYEVGWDHLNWYEIIWRYPS-NH2 |
| 1874 | JBS-1703 | Ac-VYEVGWDDGNWYEIIWRYPS-NH2 | 1915 | JBS-1744 | Ac-VYEVGWDHGLWYEIIWRYPS-NH2 |
| 1875 | JBS-1704 | Ac-VYEVGWDDGNWYEIIWRYPS-NH2 | 1916 | JBS-1745 | Ac-VYEVGWDHGNLYEIIWRYPS-NH2 |
| 1876 | JBS-1705 | Ac-VYEVGWDHDNWYEIIWRYPS-NH2 | 1917 | JBS-1746 | Ac-VYEVGWDHGNWLEIIWRYPS-NH2 |
| 1877 | JBS-1706 | Ac-VYEVGWDHGDWYEIIWRYPS-NH2 | 1918 | JBS-1747 | Ac-VYEVGWDHGNWYLIIWRYPS-NH2 |
| 1878 | JBS-1707 | Ac-VYEVGWDHGNDYEIIWRYPS-NH2 | 1919 | JBS-1748 | Ac-VYEVGWDHGNWYELIWRYPS-NH2 |
| 1879 | JBS-1708 | Ac-VYEVGWDHGNWDEIIWRYPS-NH2 | 1920 | JBS-1749 | Ac-VYEVGWDHGNWYEILRYPS-NH2 |
| 1880 | JBS-1709 | Ac-VYEVGWDHGNWYDIIWRYPS-NH2 | 1921 | JBS-1750 | Ac-VYEVGWDHGNWYEIILRYPS-NH2 |
| 1881 | JBS-1710 | Ac-VYEVGWDHGNWYEDIWRYPS-NH2 | 1922 | JBS-1751 | Ac-VYEVGWDHGNWYEIIWLYPS-NH2 |
| 1882 | JBS-1711 | Ac-VYEVGWDHGNWYEIDWRYPS-NH2 | 1923 | JBS-1752 | Ac-VYEVGWDHGNWYEIIWRLPS-NH2 |
| 1883 | JBS-1712 | Ac-VYEVGWDHGNWYEIIDRYPS-NH2 | 1924 | JBS-1753 | Ac-VYEVGWDHGNWYEIIWRYLS-NH2 |
| 1884 | JBS-1713 | Ac-VYEVGWDHGNWYEIIWDYPS-NH2 | 1925 | JBS-1754 | Ac-VYEVGWDHGNWYEIIWRYPL-NH2 |
| 1885 | JBS-1714 | Ac-VYEVGWDHGNWYEIIWRDPS-NH2 | 1926 | JBS-1755 | Ac-KYEVGWDHGNWYEIIWRYPS-NH2 |
| 1886 | JBS-1715 | Ac-VYEVGWDHGNWYEIIWRYDS-NH2 | 1927 | JBS-1756 | Ac-VKEVGWDHGNWYEIIWRYPS-NH2 |
| 1887 | JBS-1716 | Ac-VYEVGWDHGNWYEIIWRYPD-NH2 | 1928 | JBS-1757 | Ac-VYKVGWDHGNWYEIIWRYPS-NH2 |
| 1888 | JBS-1717 | Ac-GYEVGWDHGNWYEIIWRYPS-NH2 | 1929 | JBS-1758 | Ac-VYEKGWDHGNWYEIIWRYPL-NH2 |
| 1889 | JBS-1718 | Ac-VGEVGWDHGNWYEIIWRYPS-NH2 | 1930 | JBS-1759 | Ac-VYEVKWDHGNWYEIIWRYPS-NH2 |
| 1890 | JBS-1719 | Ac-VYGVGWDHGNWYEIIWRYPS-NH2 | 1931 | JBS-1760 | Ac-VYEVGKDHGNWYEIIWRYPS-NH2 |
| 1891 | JBS-1720 | Ac-VYEGGWDHGNWYEIIWRYPS-NH2 | 1932 | JBS-1761 | Ac-VYEVGWKHGNWYEIIWRYPS-NH2 |
| 1892 | JBS-1721 | Ac-VYEVGGDHGNWYEIIWRYPS-NH2 | 1933 | JBS-1762 | Ac-VYEVGWDKGNWYEIIWRYPS-NH2 |
| 1893 | JBS-1722 | Ac-VYEVGWGHGNWYEIIWRYPS-NH2 | 1934 | JBS-1763 | Ac-VYEVGWDHKNWYEIIKRYPS-NH2 |
| 1894 | JBS-1723 | Ac-VYEVGWDGGNWYEIIWRYPS-NH2 | 1935 | JBS-1764 | Ac-VYEVGWDHGKWYEIIWKYPS-NH2 |
| 1895 | JBS-1724 | Ac-VYEVGWDHGGWYEIIWGYPS-NH2 | 1936 | JBS-1765 | Ac-VYEVGWDHGNKYEIIWRKPS-NH2 |
| 1896 | JBS-1725 | Ac-VYEVGWDHGNGYEIIWRYPS-NH2 | 1937 | JBS-1766 | Ac-VYEVGWDHGNWKEIIWRYKS-NH2 |
| 1897 | JBS-1726 | Ac-VYEVGWDHGNWGEIIWRYPS-NH2 | 1938 | JBS-1767 | Ac-VYEVGWDHGNWYKIIWRYPK-NH2 |
| 1898 | JBS-1727 | Ac-VYEVGWDHGNWYGIIWRYPS-NH2 | 1939 | JBS-1768 | Ac-VYEVGWDHGNWYEKIWRYPS-NH2 |
| 1899 | JBS-1728 | Ac-VYEVGWDHGNWYEGIWRYPS-NH2 | 1940 | JBS-1769 | Ac-VYEFGWDHGNWYEIKRYPS-NH2 |
| 1900 | JBS-1729 | Ac-VYEVGWDHGNWYEIGWRYPS-NH2 | 1941 | JBS-1770 | Ac-VYEVGWDHGNWYEIIKRYPS-NH2 |
| 1901 | JBS-1730 | Ac-VYEVGWDHGNWYEIIGRYPS-NH2 | 1942 | JBS-1771 | Ac-VYEVGWDHGNWYEIIWKPS-NH2 |
| 1902 | JBS-1731 | Ac-VYEVGWDHGNWYEIIWGYPS-NH2 | 1943 | JBS-1772 | Ac-VYEVGWDHGNWYEIIWRKPS-NH2 |
| 1903 | JBS-1732 | Ac-VYEVGWDHGNWYEIIWRGPS-NH2 | 1944 | JBS-1773 | Ac-VYEVGWDHGNWYEIIWRYKS-NH2 |
| 1904 | JBS-1733 | Ac-VYEVGWDHGNWYEIIWRYGS-NH2 | 1945 | JBS-1774 | Ac-VYEVGWDHGNWYEIIWRYPK-NH2 |
| 1905 | JBS-1734 | Ac-VYEVGWDHGNWYEIIWRYPG-NH2 | 1946 | JBS-1775 | Ac-VYEVGWDHGNWYEIIWRYPS-NH2 |
| 1906 | JBS-1735 | Ac-LYEVGWDHGNWYEIIWRYPS-NH2 | 1947 | JBS-1776 | Ac-FYEVGWDHGNWYEIIWRYPS-NH2 |
| 1907 | JBS-1736 | Ac-VLEVGWDHGNWYEIIWRYPS-NH2 | 1948 | JBS-1777 | Ac-VFEVGWDHGNWYEIKWRYPS-NH2 |
| 1908 | JBS-1737 | Ac-VYLVGWDHGNWYEIIWRYPS-NH2 | 1949 | JBS-1778 | Ac-VYFVGWDHGNWYEIIWRYPS-NH2 |
| 1909 | JBS-1738 | Ac-VYELGWDHGNWYEIIWRYPS-NH2 | 1950 | JBS-1779 | Ac-VYEFGWDHGNWYEIIWRYPS-NH2 |
| 1910 | JBS-1739 | Ac-VYEVLWDHGNWYEIIWGYPS-NH2 | 1951 | JBS-1780 | Ac-VYEVGWDHGNWYEIIWRKPS-NH2 |
| 1911 | JBS-1740 | Ac-VYEVGLDHGNWYEIIWRYPS-NH2 | 1952 | JBS-1781 | Ac-VYEVGFDHGNWYEIIWRYPS-NH2 |
| 1912 | JBS-1741 | Ac-VYEVGWLHGNWYEIIWRYPS-NH2 | 1953 | JBS-1782 | Ac-VYEVGWDFGNWYEIIWRYPS-NH2 |
| 1913 | JBS-1742 | Ac-VYEVGWDLGNWYEIIWRYPS-NH2 | 1954 | JBS-1783 | Ac-VYEVGWDHFNWYEIIWRYPS-NH2 |

| SEQ ID | Compound | Sequence | SEQ ID | Compound | Sequence |
|---|---|---|---|---|---|
| 1955 | JBS-1784 | Ac-VYEVGWDHGFWYEIIWRYPS-NH2 | 1996 | JBS-1825 | Ac-VYEVGWDHGNWSEIIWRYPS-NH2 |
| 1956 | JBS-1785 | Ac-VYEVGWDHGNFYEIIWRYPS-NH2 | 1997 | JBS-1826 | Ac-VYEVGWDHGNWYSIIWRYPS-NH2 |
| 1957 | JBS-1786 | Ac-VYEVGWDHGNWFEIIWRYPS-NH2 | 1998 | JBS-1827 | Ac-VYEAGWDHGNWYESIWRYPS-NH2 |
| 1958 | JBS-1787 | Ac-VYEVGWDHGNWYFIIWRYPS-NH2 | 1999 | JBS-1828 | Ac-VYEVGWDHGNWYEISWRYPS-NH2 |
| 1959 | JBS-1788 | Ac-VYEVGWDHGNWYEIFWRYPS-NH2 | 2000 | JBS-1829 | Ac-VYEVGWDHGNWYEIISRYPS-NH2 |
| 1960 | JBS-1789 | Ac-VYEVGWDHGNWYEIFWRYPS-NH2 | 2001 | JBS-1830 | Ac-VYEVGWDHGNWYEIIWSYPS-NH2 |
| 1961 | JBS-1790 | Ac-VYEVGWDHGNWYEIIFRYPS-NH2 | 2002 | JBS-1831 | Ac-VYEVGWDHGNWYEIIWRSPS-NH2 |
| 1962 | JBS-1791 | Ac-VYEVGWDHGNWYEIIWFYPS-NH2 | 2003 | JBS-1832 | Ac-VYEVGWDHGNWYEIIWRYSS-NH2 |
| 1963 | JBS-1792 | Ac-VYEVGWDHGNWYEIIWRFPS-NH2 | 2004 | JBS-1833 | Ac-VYEVGWDHGNWYEIIWR-NH2 |
| 1964 | JBS-1793 | Ac-VYEVGWDHGNWYEIIWRYFS-NH2 | 2005 | JBS-1834 | Ac-VYEVGWDHGNWYEI-NH2 |
| 1965 | JBS-1794 | Ac-VYEVGWDHGNWYEIIWRYPF-NH2 | 2006 | JBS-1835 | Ac-VYEVGWDHGNW-NH2 |
| 1966 | JBS-1795 | Ac-PYEVGWDHGNWYEIIWRYPS-NH2 | 2007 | JBS-1836 | Ac-VGDHGNWYEIIWRYPS-NH2 |
| 1967 | JBS-1796 | Ac-VPEVGWDHGNWYEIIWRYPS-NH2 | 2008 | JBS-1837 | Ac-DHGNWYEIIWRYPS-NH2 |
| 1968 | JBS-1797 | Ac-VYPVGWDHGNWYEIIWRYPS-NH2 | 2009 | JBS-1838 | Ac-NWYEIIWRYPS-NH2 |
| 1969 | JBS-1798 | Ac-VYEPGWDHGNWYEIIWRYPS-NH2 | 2010 | JBS-1839 | Ac-VGWDHGNWYEIIWR-NH2 |
| 1970 | JBS-1799 | Ac-VYEVPWDHGNWYEIIWRYPS-NH2 | 2011 | JBS-1840 | Ac-ATVEVGWHTVHTGRDNYMWM-NH2 |
| 1971 | JBS-1800 | Ac-VYEVGPDHGNWYEIIWRYPS-NH2 | 2012 | JBS-1841 | Ac-YAVEVGWHTVHTGRDNYMWM-NH2 |
| 1972 | JBS-1801 | Ac-VYEVGWPHGNWYEIIWRYPS-NH2 | 2013 | JBS-1842 | Ac-YTAEVGWHTVHTGRDNYMWM-NH2 |
| 1973 | JBS-1802 | Ac-VYEVGWDPHGNWYEIIWRYPS-NH2 | 2014 | JBS-1843 | Ac-YTVAVGWHTVHTGRDNYMWM-NH2 |
| 1974 | JBS-1803 | Ac-VYEVGWDHPNWYEIIWRYPS-NH2 | 2015 | JBS-1844 | Ac-YTVEAGWHTVHTGRDNYMWM-NH2 |
| 1975 | JBS-1804 | Ac-VYEVGWDHGPWYEIIWRYPS-NH2 | 2016 | JBS-1845 | Ac-YTVEVAWHTVHTGRDNYMWM-NH2 |
| 1976 | JBS-1805 | Ac-VYEVGWDHGNPYEIIWRYPS-NH2 | 2017 | JBS-1846 | Ac-YTVEGAHTVHTGRDNYMWM-NH2 |
| 1977 | JBS-1806 | Ac-VYEVGWDHGNWPEIIWRYPS-NH2 | 2018 | JBS-1847 | Ac-YTVEVGMATVHTGRDNYMWM-NH2 |
| 1978 | JBS-1807 | Ac-VYEVGWDHGNWYPIIWRYPS-NH2 | 2019 | JBS-1848 | Ac-YTVEVGWHAVHTGRDNYMWM-NH2 |
| 1979 | JBS-1808 | Ac-VYEVGWDHGNWYEPIWRYPS-NH2 | 2020 | JBS-1849 | Ac-YTVEVGWHTAHTGRDNYMWM-NH2 |
| 1980 | JBS-1809 | Ac-VYEVGWDHGNWYEIPWRYPS-NH2 | 2021 | JBS-1850 | Ac-YTVEVGWHTVATGRDNYMWM-NH2 |
| 1981 | JBS-1810 | Ac-VYEVGWDHGNWYEIIPRYPS-NH2 | 2022 | JBS-1851 | Ac-YTVEVGWHTVHAGRDNYMWM-NH2 |
| 1982 | JBS-1811 | Ac-VYEVGWDHGNWYEIIWNPYPS-NH2 | 2023 | JBS-1852 | Ac-YTVEVGWHTVHTNPDNYMWM-NH2 |
| 1983 | JBS-1812 | Ac-VYEVGWDHGNWYEIIWRPPS-NH2 | 2024 | JBS-1853 | Ac-YTVEVGWHTVHTGADNYMWM-NH2 |
| 1984 | JBS-1813 | Ac-VYEVGWDHGNWYEIIWRYPP-NH2 | 2025 | JBS-1854 | Ac-YTVEVGWHTVHTGRANYMWM-NH2 |
| 1985 | JBS-1814 | Ac-SYEVGWDHGNWYEIIWRYPS-NH2 | 2026 | JBS-1855 | Ac-YTVEVGWHTVHTGRDAYMWM-NH2 |
| 1986 | JBS-1815 | Ac-VSEVGWDHGNWYEIIWRYPS-NH2 | 2027 | JBS-1856 | Ac-YTVEVGWHTVHTGRDNAMWM-NH2 |
| 1987 | JBS-1816 | Ac-VYSVGWDHGNWYEIIWRYPS-NH2 | 2028 | JBS-1857 | Ac-YTVEVGWHTVHTGRDNYAWM-NH2 |
| 1988 | JBS-1817 | Ac-VYESGWDHGNWYEIIWRYPS-NH2 | 2029 | JBS-1858 | Ac-YTVEVGWHTVHTGRDNYMAM-NH2 |
| 1989 | JBS-1818 | Ac-VYEVSWDHGNWYEIIWRYPS-NH2 | 2030 | JBS-1859 | Ac-YTVEVGWHTVHTGRDNYMWA-NH2 |
| 1990 | JBS-1819 | Ac-VYEVGSDHGNWYEIIWRYPS-NH2 | 2031 | JBS-1860 | Ac-DTVEVGWHTVHTGRDNYMWM-NH2 |
| 1991 | JBS-1820 | Ac-VYEVGSHGNWYEIIWRYPS-NH2 | 2032 | JBS-1861 | Ac-YDVEVGWHTVHTGRDNYMWM-NH2 |
| 1992 | JBS-1821 | Ac-VYEVGWDSGNWYEIIWRYPS-NH2 | 2033 | JBS-1862 | Ac-YTDEVGWHTVHTGRDNYMWM-NH2 |
| 1993 | JBS-1822 | Ac-VYEVGWDHSNWYEIIWRYPS-NH2 | 2034 | JBS-1863 | Ac-YTVDVGWHTVHTGRDNYMWM-NH2 |
| 1994 | JBS-1823 | Ac-VYEVGWDHGSWYEIIWRYPS-NH2 | 2035 | JBS-1864 | Ac-YTVEDGWHTVHTGRDNYMWM-NH2 |
| 1995 | JBS-1824 | Ac-VYEVGWDHGNSYEIIWRYPS-NH2 | 2036 | JBS-1865 | Ac-YTVEVDWHTVHTGRDNYMWM-NH2 |

FIGURE 2Y

| SEQ ID | Compound | Sequence | SEQ ID | Compound | Sequence |
|---|---|---|---|---|---|
| 2037 | JBS-1866 | Ac-YTVEVGDHTVHTGRDNYMWM-NH2 | 2078 | JBS-1907 | Ac-YTVEVGWHTVLTGRDNYMWM-NH2 |
| 2038 | JBS-1867 | Ac-YTVEVGWDTVHTGRDNYMWM-NH2 | 2079 | JBS-1908 | Ac-YTVEVGWHTVHLGRDNYMWM-NH2 |
| 2039 | JBS-1868 | Ac-YTVEVGWHDVHTGRDNYMWM-NH2 | 2080 | JBS-1909 | Ac-YTVEVGWHTVHTLRDNYMWM-NH2 |
| 2040 | JBS-1869 | Ac-YTVEVGWHTDHTGRDNYMWM-NH2 | 2081 | JBS-1910 | Ac-YTVEVGWHTVHTGLDNYMWM-NH2 |
| 2041 | JBS-1870 | Ac-YTVEVGWHTVDTGRDNYMWM-NH2 | 2082 | JBS-1911 | Ac-YTVEVGWHTVHTGRLNYMWM-NH2 |
| 2042 | JBS-1871 | Ac-YTVEVGWHTVHDGRDNYMWM-NH2 | 2083 | JBS-1912 | Ac-YTVEVGWHTVHTGRDLYMWM-NH2 |
| 2043 | JBS-1872 | Ac-YTVEVGWHTVHTDRDNYMWM-NH2 | 2084 | JBS-1913 | Ac-YTVEVGWHTVHTGRDNLMWM-NH2 |
| 2044 | JBS-1873 | Ac-YTVEVGWHTVHTGDDNYMWM-NH2 | 2085 | JBS-1914 | Ac-YTVEVGWHTVHTGRDNYLWM-NH2 |
| 2045 | JBS-1874 | Ac-YTVEVGWHTVHTGRDDYMWM-NH2 | 2086 | JBS-1915 | Ac-YTVEVGWHTVHTGRDNYMLM-NH2 |
| 2046 | JBS-1875 | Ac-YTVEVGWHTVHTGRDNDMWM-NH2 | 2087 | JBS-1916 | Ac-YTVEVGWHTVHTGRDNYMWL-NH2 |
| 2047 | JBS-1876 | Ac-YTVEVGWHTVHTGRDNYDWM-NH2 | 2088 | JBS-1917 | Ac-KTVEVGWHTVHTGRDNYMWM-NH2 |
| 2048 | JBS-1877 | Ac-YTVEVGWHTVHTGRDNYMDM-NH2 | 2089 | JBS-1918 | Ac-YKVEVGWHTVHTGRDNYMWM-NH2 |
| 2049 | JBS-1878 | Ac-YTVEVGWHTVHTGRDNYMWD-NH2 | 2090 | JBS-1919 | Ac-YTKEVGWHTVHTGRDNYMWM-NH2 |
| 2050 | JBS-1879 | Ac-GTVEVGWHTVHTGRDNYMWM-NH2 | 2091 | JBS-1920 | Ac-YTVKVGWHTVHTGRDNYMWM-NH2 |
| 2051 | JBS-1880 | Ac-YGVEVGWHTVHTGRDNYMWM-NH2 | 2092 | JBS-1921 | Ac-YTVEKGWHTVHTGRDNYMWM-NH2 |
| 2052 | JBS-1881 | Ac-YTGEVGWHTVHTGRDNYMWM-NH2 | 2093 | JBS-1922 | Ac-YTVEVKWHTVHTGRDNYMWM-NH2 |
| 2053 | JBS-1882 | Ac-YTVGVGWHTVHTGRDNYMWM-NH2 | 2094 | JBS-1923 | Ac-YTVEVGKHTVHTGRDNYMWM-NH2 |
| 2054 | JBS-1883 | Ac-YTVEGGWHTVHTGRDNYMWM-NH2 | 2095 | JBS-1924 | Ac-YTVEVGWKTVHTGRDNYMWM-NH2 |
| 2055 | JBS-1884 | Ac-YTVEVGGHTVHTGRDNYMWM-NH2 | 2096 | JBS-1925 | Ac-YTVEVGWHKVHTGRDNYMWM-NH2 |
| 2056 | JBS-1885 | Ac-YTVEVGWHTVHTGRDNYMWM-NH2 | 2097 | JBS-1926 | Ac-YTVEVGWHTKHTGRDNYMWM-NH2 |
| 2057 | JBS-1886 | Ac-YTVEVGWHTVHTGRDNYMWM-NH2 | 2098 | JBS-1927 | Ac-YTVEVGWHTVKTGRDNYMWM-NH2 |
| 2058 | JBS-1887 | Ac-YTVEVGWHTGHTGRDNYMWM-NH2 | 2099 | JBS-1928 | Ac-YTVEVGWHTVHKGRDNYMWM-NH2 |
| 2059 | JBS-1888 | Ac-YTVEVGWHTVGTGRDNYMWM-NH2 | 2100 | JBS-1929 | Ac-YTVEVGWHTVHTKRDNYMWM-NH2 |
| 2060 | JBS-1889 | Ac-YTVEVGWHTVHGGRDNYMWM-NH2 | 2101 | JBS-1930 | Ac-YTVEVGWHTVHTGKDNYMWM-NH2 |
| 2061 | JBS-1890 | Ac-YTVEVGWHTVHTGGDNYMWG-NH2 | 2102 | JBS-1931 | Ac-YTVEVGWHTVHTGRKNYMWM-NH2 |
| 2062 | JBS-1891 | Ac-LTVEVGWHTVHTGRGNYMWM-NH2 | 2103 | JBS-1932 | Ac-FTVEVGWHTVHTGRDKYMWM-NH2 |
| 2063 | JBS-1892 | Ac-YTVEVGWHTVHTGRDGYMWM-NH2 | 2104 | JBS-1933 | Ac-YTVEVGWHTVHTGRDNKMWM-NH2 |
| 2064 | JBS-1893 | Ac-YTVEVGWHTVHTGRDNGMWM-NH2 | 2105 | JBS-1934 | Ac-YTVEVGWHTVHTGRDNYKWM-NH2 |
| 2065 | JBS-1894 | Ac-YTVEVGWHTVHTGRDNYGWM-NH2 | 2106 | JBS-1935 | Ac-YTVEVGWHTVHTGRDNYMKM-NH2 |
| 2066 | JBS-1895 | Ac-YTVEVGWHTVHTGRDNYMGM-NH2 | 2107 | JBS-1936 | Ac-YTVEVGWHTVHTGRDNYMWK-NH2 |
| 2067 | JBS-1896 | Ac-YTVEVGWHTVHTGRDNYMWG-NH2 | 2108 | JBS-1937 | Ac-FTVEVGWHTVHTGRKNYMWM-NH2 |
| 2068 | JBS-1897 | Ac-YTVEVGWHTVHTGRGNYMWM-NH2 | 2109 | JBS-1938 | Ac-YTVEVGFHTVHTGRDKYMWM-NH2 |
| 2069 | JBS-1898 | Ac-YTVEVGWHTVHTGRDGYMWM-NH2 | 2110 | JBS-1939 | Ac-YTFEVGWHTVHTGRDNYMWM-NH2 |
| 2070 | JBS-1899 | Ac-YTLEVGWHTVHTGRDNYMWM-NH2 | 2111 | JBS-1940 | Ac-YTVFVGWHTVHTGRDNYMWM-NH2 |
| 2071 | JBS-1900 | Ac-YTVLVGWHTVHTGRDNYMWM-NH2 | 2112 | JBS-1941 | Ac-YTVEFGWHTVHTGRDNYMWM-NH2 |
| 2072 | JBS-1901 | Ac-YTVELGWHTVHTGRDNYMWM-NH2 | 2113 | JBS-1942 | Ac-YTVEVFWHTVHTGRDNYMWM-NH2 |
| 2073 | JBS-1902 | Ac-YTVEVLWHTVHTGRDNYMWM-NH2 | 2114 | JBS-1943 | Ac-YTVEVGFHTVHTGRDNYMWM-NH2 |
| 2074 | JBS-1903 | Ac-YTVEVGLHTVHTGRDNYMWM-NH2 | 2115 | JBS-1944 | Ac-YTVEVGWFTVHTGRDNYMWM-NH2 |
| 2075 | JBS-1904 | Ac-YTVEVGWLTVHTGRDNYMWM-NH2 | 2116 | JBS-1945 | Ac-YTVEVGWHFVHTGRDNYMWM-NH2 |
| 2076 | JBS-1905 | Ac-YTVEVGWHLVHTGRDNYMWM-NH2 | 2117 | JBS-1946 | Ac-YTVEVGWHTFHTGRDNYMWM-NH2 |
| 2077 | JBS-1906 | Ac-YTVEVGWHTLHTGRDNYMWM-NH2 | 2118 | JBS-1947 | Ac-YTVEVGWHTVFTGRDNYMWM-NH2 |

FIGURE 2Z

| SEQ ID | Compound | Sequence | SEQ ID | Compound | Sequence |
|---|---|---|---|---|---|
| 2119 | JBS-1948 | Ac-YTVEVGWHTVHFGRDNYMWM-NH2 | 2160 | JBS-1989 | Ac-YTVEVGWHTVHTSRDNYMWM-NH2 |
| 2120 | JBS-1949 | Ac-YTVEVGWHTVHFRDNYMWM-NH2 | 2161 | JBS-1990 | Ac-YTVEVGWHTVHTGSDNYMWM-NH2 |
| 2121 | JBS-1950 | Ac-YTVEVGWHTVHTGFDNYMWM-NH2 | 2162 | JBS-1991 | Ac-YTVEVGWHTVHTGRSNYMWM-NH2 |
| 2122 | JBS-1951 | Ac-YTVEVGWHTVHTGRFNYMWM-NH2 | 2163 | JBS-1992 | Ac-YTVEVGWHTVHTGRDSYMWM-NH2 |
| 2123 | JBS-1952 | Ac-YTVEVGWHTVHTGRDFYMWM-NH2 | 2164 | JBS-1993 | Ac-YTVEVGWHTVHTGRDNSMWM-NH2 |
| 2124 | JBS-1953 | Ac-YTVEVGWHTVHTGRDNFMWM-NH2 | 2165 | JBS-1994 | Ac-YTVEVGWHTVHTGRDNYSWM-NH2 |
| 2125 | JBS-1954 | Ac-YTVEVGWHTVHTGRDNYFWM-NH2 | 2166 | JBS-1995 | Ac-YTVEVGWHTVHTGRDNYMSM-NH2 |
| 2126 | JBS-1955 | Ac-YTVEVGWHTVHTGRDNYMFM-NH2 | 2167 | JBS-1996 | Ac-YTVEVGWHTVHTGRDNYMWS-NH2 |
| 2127 | JBS-1956 | Ac-YTVEVGWHTVHTGRDNYMWF-NH2 | 2168 | JBS-1997 | Ac-YTVEVGWHTVHTGRDNY-NH2 |
| 2128 | JBS-1957 | Ac-PTVEVGWHTVHTGRDNYMWM-NH2 | 2169 | JBS-1998 | Ac-YTVEVGWHTVHTGR-NH2 |
| 2129 | JBS-1958 | Ac-YPVEVGWHTVHTGRDNYMwM-NH2 | 2170 | JBS-1999 | Ac-YTVEVGWHTVH-NH2 |
| 2130 | JBS-1959 | Ac-YTPEVGWHTVHTGRDNYMWM-NH2 | 2171 | JBS-2000 | Ac-EVGWHTVHTGRDNYMWM-NH2 |
| 2131 | JBS-1960 | Ac-YTVPVGWHTVHTGRDNYMWM-NH2 | 2172 | JBS-2001 | Ac-WHTVHTGRDNYMWM-NH2 |
| 2132 | JBS-1961 | Ac-YTVEPGWHTVHTGRDNYMWM-NH2 | 2173 | JBS-2002 | Ac-VHTGRDNYMWM-NH2 |
| 2133 | JBS-1962 | Ac-YTVEVPWHTVHTGRDNYMwM-NH2 | 2174 | JBS-2003 | Ac-EVGWHTVHTGRDNY-NH2 |
| 2134 | JBS-1963 | Ac-YTVEVGPHTVHTGRDNYMWM-NH2 | 2175 | JBS-2004 | Ac-AVQIGWYSDSDRHYAYSSY-NH2 |
| 2135 | JBS-1964 | Ac-YTVEVGWPTVHTGRDNYMWM-NH2 | 2176 | JBS-2005 | Ac-HAQIGWYSVDSDRHYAYSSY-NH2 |
| 2136 | JBS-1965 | Ac-YTVEVGWHPVHTGRDNYMWM-NH2 | 2177 | JBS-2006 | Ac-HVAIGWYSVDSDRHYAYSSY-NH2 |
| 2137 | JBS-1966 | Ac-YTVEVGWHTPHTGRDNYMWM-NH2 | 2178 | JBS-2007 | Ac-HVQAGWYSVDSDRHYAYSSY-NH2 |
| 2138 | JBS-1967 | Ac-YTVEVGWHTVPTGRDNYMWM-NH2 | 2179 | JBS-2008 | Ac-HVQIAWYSVDSDRHYAYSSY-NH2 |
| 2139 | JBS-1968 | Ac-YTVEVGWHTVHPGRDNYMWM-NH2 | 2180 | JBS-2009 | Ac-HVQIGAYSVDSDRHYAYSSY-NH2 |
| 2140 | JBS-1969 | Ac-YTVEVGWHTVHTPRDNYMWM-NH2 | 2181 | JBS-2010 | Ac-HVQIGWASVDSDRHYAYSSY-NH2 |
| 2141 | JBS-1970 | Ac-YTVEVGWHTVHTGPDNYMWM-NH2 | 2182 | JBS-2011 | Ac-HVQIGWYAVDSDRHYAYSSY-NH2 |
| 2142 | JBS-1971 | Ac-YTVEVGWHTVHTGRPNYMWM-NH2 | 2183 | JBS-2012 | Ac-HVQIGWYSADSDRHYAYSSY-NH2 |
| 2143 | JBS-1972 | Ac-YTVEVGWHTVHTGRDPYMWM-NH2 | 2184 | JBS-2013 | Ac-HVQIGWYSVASDRHYAYSSY-NH2 |
| 2144 | JBS-1973 | Ac-YTVEVGWHTVHTGRDNPMWM-NH2 | 2185 | JBS-2014 | Ac-HVQIGWYSVDADRHYAYSSY-NH2 |
| 2145 | JBS-1974 | Ac-YTVEVGWHTVHTGRDNYPWM-NH2 | 2186 | JBS-2015 | Ac-HVQIGWYSVDSARHYAYSSY-NH2 |
| 2146 | JBS-1975 | Ac-YTVEVGWHTVHTGRDNYMPM-NH2 | 2187 | JBS-2016 | Ac-HVQIGWYSVDSDAHYAYSSY-NH2 |
| 2147 | JBS-1976 | Ac-YTVEVGWHTVHTGRDNYMwP-NH2 | 2188 | JBS-2017 | Ac-HVQIGWYSVDSDRAYAYSSY-NH2 |
| 2148 | JBS-1977 | Ac-STVEVGWHTVHTGRDNYMWM-NH2 | 2189 | JBS-2018 | Ac-HVQIGWYSVDSDRHAAYSSY-NH2 |
| 2149 | JBS-1978 | Ac-YSVEVGWHTVHTGRDNYMWM-NH2 | 2190 | JBS-2019 | Ac-HVQIGWYSVDSDRHYAASSY-NH2 |
| 2150 | JBS-1979 | Ac-YTSEVGWHTVHTGRDNYMWM-NH2 | 2191 | JBS-2020 | Ac-HVQIGWYSVDSDRHYAYASY-NH2 |
| 2151 | JBS-1980 | Ac-YTVSVGWHTVHTGRDNYMWM-NH2 | 2192 | JBS-2021 | Ac-HVQIGWYSVDSDRHYAYSAY-NH2 |
| 2152 | JBS-1981 | Ac-YTVESGWHTVHTGRDNYMWM-NH2 | 2193 | JBS-2022 | Ac-HVQIGWYSVDSDRHYAYSSA-NH2 |
| 2153 | JBS-1982 | Ac-YTVEVSWHTVHTGRDNYMWM-NH2 | 2194 | JBS-2023 | Ac-DVQIGWYSVDSDRHYAYSSY-NH2 |
| 2154 | JBS-1983 | Ac-YTVEVGSHTVHTGRDNYMWM-NH2 | 2195 | JBS-2024 | Ac-HDQIGWYSVDSDRHYAYSSY-NH2 |
| 2155 | JBS-1984 | Ac-YTVEVGWSTVHTGRDNYMWM-NH2 | 2196 | JBS-2025 | Ac-HVDIGWYSVDSDRHYAYSSY-NH2 |
| 2156 | JBS-1985 | Ac-YTVEVGWHSVHTGRDNYMWM-NH2 | 2197 | JBS-2026 | Ac-HVQDGWYSVDSDRHYAYSSY-NH2 |
| 2157 | JBS-1986 | Ac-YTVEVGWHTSHTGRDNYMWM-NH2 | 2198 | JBS-2027 | Ac-HVQIDWYSVDSDRHYAYSSY-NH2 |
| 2158 | JBS-1987 | Ac-YTVEVGWHTVSTGRDNYMWM-NH2 | 2199 | JBS-2028 | Ac-HVQIGDYSVDSDRHYAYSSY-NH2 |
| 2159 | JBS-1988 | Ac-YTVEVGWHTVHSGRDNYMWM-NH2 | 2200 | JBS-2029 | Ac-HVQIGWDSVDSDRHYAYSSY-NH2 |

FIGURE 2AA

| SEQ ID | Compound | Sequence | SEQ ID | Compound | Sequence |
| --- | --- | --- | --- | --- | --- |
| 2201 | JBS-2030 | Ac-HVQIGWYDVDSDRHYAYSSY-NH2 | 2242 | JBS-2071 | Ac-HVQIGWYSVDSLRHYAYSSY-NH2 |
| 2202 | JBS-2031 | Ac-HVQIGWYSDDSDRHYAYSSY-NH2 | 2243 | JBS-2072 | Ac-HVQIGWYSVDSDLHYAYSSY-NH2 |
| 2203 | JBS-2032 | Ac-HVQIGWYSVDDDRHYAYSSY-NH2 | 2244 | JBS-2073 | Ac-HVQIGWYSVDSDRLYAYSSY-NH2 |
| 2204 | JBS-2033 | Ac-HVQIGWYSVDSDDHYAYSSY-NH2 | 2245 | JBS-2074 | Ac-HVQIGWYSVDSDRHLAYSSY-NH2 |
| 2205 | JBS-2034 | Ac-HVQIGWYSVDSDRDYAYSSY-NH2 | 2246 | JBS-2075 | Ac-HVQIGWYSVDSDRHYLYSSY-NH2 |
| 2206 | JBS-2035 | Ac-HVQIGWYSVDSDRHDAYSSY-NH2 | 2247 | JBS-2076 | Ac-HVQIGWYSVDSDRHYALSSY-NH2 |
| 2207 | JBS-2036 | Ac-HVQIGWYSVDSDRHYDYSSY-NH2 | 2248 | JBS-2077 | Ac-HVQIGWYSVDSDRHYAYLSY-NH2 |
| 2208 | JBS-2037 | Ac-HVQIGWYSVDSDRHYADSSY-NH2 | 2249 | JBS-2078 | Ac-HVQIGWYSVDSDRHYAYSLY-NH2 |
| 2209 | JBS-2038 | Ac-HVQIGWYSVDSDRHYAYDSY-NH2 | 2250 | JBS-2079 | Ac-HVQIGWYSVDSDRHYAYSSL-NH2 |
| 2210 | JBS-2039 | Ac-HVQIGWYSVDSDRHYAYSDY-NH2 | 2251 | JBS-2080 | Ac-KVQIGWYSVDSDRHYAYSSY-NH2 |
| 2211 | JBS-2040 | Ac-HVQIGWYSVDSDRHYAYSSD-NH2 | 2252 | JBS-2081 | Ac-HKQIGWYSVDSDRHYAYSSY-NH2 |
| 2212 | JBS-2041 | Ac-GVQIGWYSVDSDRHYAYSSY-NH2 | 2253 | JBS-2082 | Ac-HVKIGWYSVDSDRHYAYSSY-NH2 |
| 2213 | JBS-2042 | Ac-HGQIGWYSVDSDRHYAYSSY-NH2 | 2254 | JBS-2083 | Ac-HVQKGWYSVDSDRHYAYSSY-NH2 |
| 2214 | JBS-2043 | Ac-HVGIGWYSVDSDRHYAYSSY-NH2 | 2255 | JBS-2084 | Ac-HVQIKWYSVDSDRHYAYSSY-NH2 |
| 2215 | JBS-2044 | Ac-HVQGGWYSVDSDRHYAYSSY-NH2 | 2256 | JBS-2085 | Ac-HVQIGKYSVDSDRHYAYSSY-NH2 |
| 2216 | JBS-2045 | Ac-HVQIGGYSVDSDRHYAYSSY-NH2 | 2257 | JBS-2086 | Ac-HVQIGWKSVDSDRHYAYSSY-NH2 |
| 2217 | JBS-2046 | Ac-HVQIGWGSVDSDRHYAYSSY-NH2 | 2258 | JBS-2087 | Ac-HVQIGWYKVDSDRHYAYSSY-NH2 |
| 2218 | JBS-2047 | Ac-HVQIGWYGVDSDRHYAYSSY-NH2 | 2259 | JBS-2088 | Ac-HVQIGWYSKDSDRHYAYSSY-NH2 |
| 2219 | JBS-2048 | Ac-HVQIGWYSGDSDRHYAYSSY-NH2 | 2260 | JBS-2089 | Ac-HVQIGWYSVKSDRHYAYSSY-NH2 |
| 2220 | JBS-2049 | Ac-HVQIGWYSVGDRHYAYSSY-NH2 | 2261 | JBS-2090 | Ac-HVQIGWYSVDKDRHYAYSSY-NH2 |
| 2221 | JBS-2050 | Ac-HVQIGWYSVDGRHYAYSSY-NH2 | 2262 | JBS-2091 | Ac-HVQIGWYSVDSKRHYAYSSY-NH2 |
| 2222 | JBS-2051 | Ac-HVQIGWYSVDSGHYAYSSY-NH2 | 2263 | JBS-2092 | Ac-HVQIGWYSVDSDKHYAYSSY-NH2 |
| 2223 | JBS-2052 | Ac-HVQIGWYSVDSDGHYAYSSY-NH2 | 2264 | JBS-2093 | Ac-HVQIGWYSVDSDRKYAYSSY-NH2 |
| 2224 | JBS-2053 | Ac-HVQIGWYSVDSDRGYAYSSY-NH2 | 2265 | JBS-2094 | Ac-HVQIGWYSVDSDRHKAYSSY-NH2 |
| 2225 | JBS-2054 | Ac-HVQIGWYSVDSDRHGAYSSY-NH2 | 2266 | JBS-2095 | Ac-HVQIGWYSVDSDRHYKYSSY-NH2 |
| 2226 | JBS-2055 | Ac-HVQIGWYSVDSDRHYGYSSY-NH2 | 2267 | JBS-2096 | Ac-HVQIGWYSVDSDRHYAKSSY-NH2 |
| 2227 | JBS-2056 | Ac-HVQIGWYSVDSDRHYAGSSY-NH2 | 2268 | JBS-2097 | Ac-HVQIGWYSVDSDRHYAYKSY-NH2 |
| 2228 | JBS-2057 | Ac-HVQIGWYSVDSDRHYAYGSY-NH2 | 2269 | JBS-2098 | Ac-HVQIGWYSVDSDRHYAYSKY-NH2 |
| 2229 | JBS-2058 | Ac-HVQIGWYSVDSDRHYAYSGY-NH2 | 2270 | JBS-2099 | Ac-HVQIGWYSVDSDRHYAYSSK-NH2 |
| 2230 | JBS-2059 | Ac-HVQIGWYSVDSDRHYAYSSG-NH2 | 2271 | JBS-2100 | Ac-FVQIGWYSVDSDRHYAYSSY-NH2 |
| 2231 | JBS-2060 | Ac-LVQIGWYSVDSDRHYAYSSY-NH2 | 2272 | JBS-2101 | Ac-HFQIGWYSVDSDRHYAYSSY-NH2 |
| 2232 | JBS-2061 | Ac-HLQIGWYSVDSDRHYAYSSY-NH2 | 2273 | JBS-2102 | Ac-HVFIGWYSVDSDRHYAYSSY-NH2 |
| 2233 | JBS-2062 | Ac-HVLIGWYSVDSDRHYAYSSY-NH2 | 2274 | JBS-2103 | Ac-HVQFGWYSVDSDRHYAYSSY-NH2 |
| 2234 | JBS-2063 | Ac-HVQLGWYSVDSDRHYAYSSY-NH2 | 2275 | JBS-2104 | Ac-HVQIFWYSVDSDRHYAYSSY-NH2 |
| 2235 | JBS-2064 | Ac-HVQILWYSVDSDRHYAYSSY-NH2 | 2276 | JBS-2105 | Ac-HVQIGFYSVDSDRHYAYSSY-NH2 |
| 2236 | JBS-2065 | Ac-HVQIGLYSVDSDRHYAYSSY-NH2 | 2277 | JBS-2106 | Ac-HVQIGWFSVDSDRHYAYSSY-NH2 |
| 2237 | JBS-2066 | Ac-HVQIGWLSVDSDRHYAYSSY-NH2 | 2278 | JBS-2107 | Ac-HVQIGWYFVDSDRHYAYSSY-NH2 |
| 2238 | JBS-2067 | Ac-HVQIGWYLVDSDRHYAYSSY-NH2 | 2279 | JBS-2108 | Ac-HVQIGWYSFDSDRHYAYSSY-NH2 |
| 2239 | JBS-2068 | Ac-HVQIGWYSLDSDRHYAYSSY-NH2 | 2280 | JBS-2109 | Ac-HVQIGWYSVFSDRHYAYSSY-NH2 |
| 2240 | JBS-2069 | Ac-HVQIGWYSVLSDRHYAYSSY-NH2 | 2281 | JBS-2110 | Ac-HVQIGWYSVDFDRHYAYSSY-NH2 |
| 2241 | JBS-2070 | Ac-HVQIGWYSVDLDRHYAYSSY-NH2 | 2282 | JBS-2111 | Ac-HVQIGWYSVDSFRHYAYSSY-NH2 |

| SEQ ID | Compound | Sequence | SEQ ID | Compound | Sequence |
|---|---|---|---|---|---|
| 2283 | JBS-2112 | Ac-HVQIGWYSVDSDFHYAYSSY-NH2 | 2324 | JBS-2153 | Ac-HVQIGWYSVDSDRHYSYSSY-NH2 |
| 2284 | JBS-2113 | Ac-HVQIGWYSVDSDRFYAYSSY-NH2 | 2325 | JBS-2154 | Ac-HVQIGWYSVDSDRHYASSSY-NH2 |
| 2285 | JBS-2114 | Ac-HVQIGWYSVDSDRHFAYSSY-NH2 | 2326 | JBS-2155 | Ac-HVQIGWYSVDSDRHYAYSSS-NH2 |
| 2286 | JBS-2115 | Ac-HVQIGWYSVDSDRHYFYSSY-NH2 | 2327 | JBS-2156 | Ac-HVQIGWYSVDSDRHYAY-NH2 |
| 2287 | JBS-2116 | Ac-HVQIGWYSVDSDRHYAFSSY-NH2 | 2328 | JBS-2157 | Ac-HVQIGWYSVDSDRH-NH2 |
| 2288 | JBS-2117 | Ac-HVQIGWYSVDSDRHYAYFSY-NH2 | 2329 | JBS-2158 | Ac-HVQIGWYSVDS-NH2 |
| 2289 | JBS-2118 | Ac-HVQIGWYSVDSDRHYAYSFY-NH2 | 2330 | JBS-2159 | Ac-IGWYSVDSDRHYAYSSY-NH2 |
| 2290 | JBS-2119 | Ac-HVQIGWYSVDSDRHYAYSSF-NH2 | 2331 | JBS-2160 | Ac-YSVDSDRHYAYSSY-NH2 |
| 2291 | JBS-2120 | Ac-PVQIGWYSVDSDRHYAYSSY-NH2 | 2332 | JBS-2161 | Ac-DSDRHYAYSSY-NH2 |
| 2292 | JBS-2121 | Ac-HPQIGWYSVDSDRHYAYSSY-NH2 | 2333 | JBS-2162 | Ac-IGWYSVDSDRHYAY-NH2 |
| 2293 | JBS-2122 | Ac-HVPIGWYSVDSDRHYAYSSY-NH2 | 2334 | JBS-2163 | Ac-AQVWWGPKARMGLIEYGWE-NH2 |
| 2294 | JBS-2123 | Ac-HVQPGWYSVDSDRHYAYSSY-NH2 | 2335 | JBS-2164 | Ac-DAVWWGPKARMGLIEYGWE-NH2 |
| 2295 | JBS-2124 | Ac-HVQIPWYSVDSDRHYAYSSY-NH2 | 2336 | JBS-2165 | Ac-DQAWWGPKARMGLIEYGWE-NH2 |
| 2296 | JBS-2125 | Ac-HVQIGPYSVDSDRHYAYSSY-NH2 | 2337 | JBS-2166 | Ac-DQVAWWGPKARMGLIEYGWE-NH2 |
| 2297 | JBS-2126 | Ac-HVQIGWPSVDSDRHYAYSSY-NH2 | 2338 | JBS-2167 | Ac-DQVWAWGPKARMGLIEYGWE-NH2 |
| 2298 | JBS-2127 | Ac-HVQIGWYPVDSDRHYAYSSY-NH2 | 2339 | JBS-2168 | Ac-DQVWWAGPKARMGLIEYGWE-NH2 |
| 2299 | JBS-2128 | Ac-HVQIGWYSPDSDRHYAYSSY-NH2 | 2340 | JBS-2169 | Ac-DQVWWAPKARMGLIEYGWE-NH2 |
| 2300 | JBS-2129 | Ac-HVQIGWYSVPSDRHYAYSSY-NH2 | 2341 | JBS-2170 | Ac-DQVWWGAKARMGLIEYGWE-NH2 |
| 2301 | JBS-2130 | Ac-HVQIGWYSVDPDRHYAYSSY-NH2 | 2342 | JBS-2171 | Ac-DQVWWGPAARMGLIEYGWE-NH2 |
| 2302 | JBS-2131 | Ac-HVQIGWYSVDSPRHYAYSSY-NH2 | 2343 | JBS-2172 | Ac-DQVWWGPKAAMGLIEYGWE-NH2 |
| 2303 | JBS-2132 | Ac-HVQIGWYSVDSDPHYAYSSY-NH2 | 2344 | JBS-2173 | Ac-DQVWWGPKARAGLIEYGWE-NH2 |
| 2304 | JBS-2133 | Ac-HVQIGWYSVDSDRPYAYSSY-NH2 | 2345 | JBS-2174 | Ac-DQVWWGPKARMALIEYGWE-NH2 |
| 2305 | JBS-2134 | Ac-HVQIGWYSVDSDRHPAYSSY-NH2 | 2346 | JBS-2175 | Ac-DQVWWGPKARMGAIEYGWE-NH2 |
| 2306 | JBS-2135 | Ac-HVQIGWYSVDSDRHYPYSSY-NH2 | 2347 | JBS-2176 | Ac-DQVWWGPKARMGLAEYGWE-NH2 |
| 2307 | JBS-2136 | Ac-HVQIGWYSVDSDRHYAPSSY-NH2 | 2348 | JBS-2177 | Ac-DQVWWGPKARMGLIAYGWE-NH2 |
| 2308 | JBS-2137 | Ac-HVQIGWYSVDSDRHYAYPSY-NH2 | 2349 | JBS-2178 | Ac-DQVWWGPKARMGLIEAGWE-NH2 |
| 2309 | JBS-2138 | Ac-HVQIGWYSVDSDRHYAYSPY-NH2 | 2350 | JBS-2179 | Ac-DQVWWGPKARMGLIEYAWE-NH2 |
| 2310 | JBS-2139 | Ac-HVQIGWYSVDSDRHYAYSSP-NH2 | 2351 | JBS-2180 | Ac-DQVWWGPKARMGLIEYGAE-NH2 |
| 2311 | JBS-2140 | Ac-SVQIGWYSVDSDRHYAYSSY-NH2 | 2352 | JBS-2181 | Ac-DQVWWGPKARMGLIEYGWA-NH2 |
| 2312 | JBS-2141 | Ac-HSQIGWYSVDSDRHYAYSSY-NH2 | 2353 | JBS-2182 | Ac-DDVWWGPKARMGLIEYGWE-NH2 |
| 2313 | JBS-2142 | Ac-HVSIGWYSVDSDRHYAYSSY-NH2 | 2354 | JBS-2183 | Ac-DQDWWGPKARMGLIEYGWE-NH2 |
| 2314 | JBS-2143 | Ac-HVQSGWYSVDSDRHYAYSSY-NH2 | 2355 | JBS-2184 | Ac-DQVDWWGPKARMGLIEYGWE-NH2 |
| 2315 | JBS-2144 | Ac-HVQISWYSVDSDRHYAYSSY-NH2 | 2356 | JBS-2185 | Ac-DQVWDWGPKARMGLIEYGWE-NH2 |
| 2316 | JBS-2145 | Ac-HVQIGSYSVDSDRHYAYSSY-NH2 | 2357 | JBS-2186 | Ac-DQVWWDGPKARMGLIEYGWE-NH2 |
| 2317 | JBS-2146 | Ac-HVQIGWSSVDSDRHYAYSSY-NH2 | 2358 | JBS-2187 | Ac-DQVWWGDKARMGLIEYGWE-NH2 |
| 2318 | JBS-2147 | Ac-HVQIGWYSSDSDRHYAYSSY-NH2 | 2359 | JBS-2188 | Ac-DQVWWGDPARMGLIEYGWE-NH2 |
| 2319 | JBS-2148 | Ac-HVQIGWYSVSSDRHYAYSSY-NH2 | 2360 | JBS-2189 | Ac-DQVWWGPDARMGLIEYGWE-NH2 |
| 2320 | JBS-2149 | Ac-HVQIGWYSVDSSRHYAYSSY-NH2 | 2361 | JBS-2190 | Ac-DQVWWGPKDRMGLIEYGWE-NH2 |
| 2321 | JBS-2150 | Ac-HVQIGWYSVDSDSHYAYSSY-NH2 | 2362 | JBS-2191 | Ac-DQVWWGPKADMGLIEYGWE-NH2 |
| 2322 | JBS-2151 | Ac-HVQIGWYSVDSDRSYAYSSY-NH2 | 2363 | JBS-2192 | Ac-DQVWWGPKARDGLIEYGWE-NH2 |
| 2323 | JBS-2152 | Ac-HVQIGWYSVDSDRHSAYSSY-NH2 | 2364 | JBS-2193 | Ac-DQVWWGPKARMDLIEYGWE-NH2 |

| SEQ ID | Compound | Sequence | SEQ ID | Compound | Sequence |
|---|---|---|---|---|---|
| 2365 | JBS-2194 | Ac-DQVWWWGPKARMGDLIEYGWE-NH2 | 2406 | JBS-2235 | Ac-DQVWWWGPKARMGLIEYGLE-NH2 |
| 2366 | JBS-2195 | Ac-DQVWWWGPKARMGLLDEYGWE-NH2 | 2407 | JBS-2236 | Ac-DQVWWWGPKARMGLIEYGWL-NH2 |
| 2367 | JBS-2196 | Ac-DQVWWWGPKARMGLIDYGWE-NH2 | 2408 | JBS-2237 | Ac-KQVWWWGPKARMGLIEYGWE-NH2 |
| 2368 | JBS-2197 | Ac-DQVWWWGPKARMGLIEDGWE-NH2 | 2409 | JBS-2238 | Ac-DKVWWWGPKARMGLIEYGWE-NH2 |
| 2369 | JBS-2198 | Ac-DQVWWWGPKARMGLIEYDWE-NH2 | 2410 | JBS-2239 | Ac-DQKWWWGPKARMGLIEYGWE-NH2 |
| 2370 | JBS-2199 | Ac-DQVWWWGPKARMGLIEYGDE-NH2 | 2411 | JBS-2240 | Ac-DQVKWWGPKARMGLIEYGWE-NH2 |
| 2371 | JBS-2200 | Ac-DQVWWWGPKARMGLIEYGWD-NH2 | 2412 | JBS-2241 | Ac-DQVWKWGPKARMGLIEYGWE-NH2 |
| 2372 | JBS-2201 | Ac-GQVWWWGPKARMGLLEYGWE-NH2 | 2413 | JBS-2242 | Ac-DQVWWKGPKARMGLIEYGWE-NH2 |
| 2373 | JBS-2202 | Ac-DGVWWWGPKARMGLIEYGWE-NH2 | 2414 | JBS-2243 | Ac-DQVWWWKPKARMGLIEYGWE-NH2 |
| 2374 | JBS-2203 | Ac-DQGWWWGPKARMGLIEYGWE-NH2 | 2415 | JBS-2244 | Ac-DQVWWWGKKARMGLIEYGWE-NH2 |
| 2375 | JBS-2204 | Ac-DQVGWWGPKARMGLIEYGWE-NH2 | 2416 | JBS-2245 | Ac-DQVWWWGPKKRMGLIEYGWE-NH2 |
| 2376 | JBS-2205 | Ac-DQVWGWGPKARMGLLEYGWE-NH2 | 2417 | JBS-2246 | Ac-DQVWWWGPKAKMGLIEYGWE-NH2 |
| 2377 | JBS-2206 | Ac-DQVWWGGPKARMGLIEYGWE-NH2 | 2418 | JBS-2247 | Ac-DQVWWWGPKARKGLIEYGWE-NH2 |
| 2378 | JBS-2207 | Ac-DQVWWWGPKARMGLIEYGWE-NH2 | 2419 | JBS-2248 | Ac-DQVWWWGPKARMKLIEYGWE-NH2 |
| 2379 | JBS-2208 | Ac-DQVWWWGPGARMGLLEYGWE-NH2 | 2420 | JBS-2249 | Ac-DQVWWWGPKARMGKIEYGWE-NH2 |
| 2380 | JBS-2209 | Ac-DQVWWWGPKGRMGLLEYGWE-NH2 | 2421 | JBS-2250 | Ac-DQVWWWGPKARMGLKEYGWE-NH2 |
| 2381 | JBS-2210 | Ac-DQVWWWGPKAGMGLIEYGWE-NH2 | 2422 | JBS-2251 | Ac-DQVWWWGPKARMGLIKYGWE-NH2 |
| 2382 | JBS-2211 | Ac-DQVWWWGPKARGGLIEYGWE-NH2 | 2423 | JBS-2252 | Ac-DQVWWWGPKARMGLIEKGWE-NH2 |
| 2383 | JBS-2212 | Ac-DQVWWWGPKARMGGIEYGWE-NH2 | 2424 | JBS-2253 | Ac-DQVWWWGPKARMGLIEYKWE-NH2 |
| 2384 | JBS-2213 | Ac-DQVWWWGPKARMGLGEYGWE-NH2 | 2425 | JBS-2254 | Ac-DQVWWWGPKARMGLIEYGKE-NH2 |
| 2385 | JBS-2214 | Ac-DQVWWWGPKARMGLIGYGWE-NH2 | 2426 | JBS-2255 | Ac-DQVWWWGPKARMGLIEYGWK-NH2 |
| 2386 | JBS-2215 | Ac-DQVWWWGPKARMGLIEGGWE-NH2 | 2427 | JBS-2256 | Ac-FQVWWWGPKARMGLIEYGWE-NH2 |
| 2387 | JBS-2216 | Ac-DQVWWWGPKARMGLIEYGGE-NH2 | 2428 | JBS-2257 | Ac-DFVWWWGPKARMGLIEYGWE-NH2 |
| 2388 | JBS-2217 | Ac-DQVWWWGPKARMGLIEYGWG-NH2 | 2429 | JBS-2258 | Ac-DQFWWWGPKARMGLIEYGWE-NH2 |
| 2389 | JBS-2218 | Ac-LQVWWWGPKARMGLIEYGWE-NH2 | 2430 | JBS-2259 | Ac-DQVFWWGPKARMGLIEYGWE-NH2 |
| 2390 | JBS-2219 | Ac-DLVWWWGPKARMGLIEYGWE-NH2 | 2431 | JBS-2260 | Ac-DQVWFWGPKARMGLIEYGWE-NH2 |
| 2391 | JBS-2220 | Ac-DQLWWWGPKARMGLIEYGWE-NH2 | 2432 | JBS-2261 | Ac-DQVWWFGPKARMGLIEYGWE-NH2 |
| 2392 | JBS-2221 | Ac-DQVLWWGPKARMGLIEYGWE-NH2 | 2433 | JBS-2262 | Ac-DQVWWWFPKARMGLIEYGWE-NH2 |
| 2393 | JBS-2222 | Ac-DQVWLWGPKARMGLIEYGWE-NH2 | 2434 | JBS-2263 | Ac-DQVWWWGFKARMGLIEYGWE-NH2 |
| 2394 | JBS-2223 | Ac-DQVWWLGPKARMGLIEYGWE-NH2 | 2435 | JBS-2264 | Ac-DQVWWWGPFARMGLIEYGWE-NH2 |
| 2395 | JBS-2224 | Ac-DQVWWWLPKARMGLIEYGWE-NH2 | 2436 | JBS-2265 | Ac-DQVWWWGPKFRMGLIEYGWE-NH2 |
| 2396 | JBS-2225 | Ac-DQVWWWGLKARMGLIEYGWE-NH2 | 2437 | JBS-2266 | Ac-DQVWWWGPKAFMGLIEYGWE-NH2 |
| 2397 | JBS-2226 | Ac-DQVWWWGPLARMGLIEYGWE-NH2 | 2438 | JBS-2267 | Ac-DQVWWWGPKARFGLIEYGWE-NH2 |
| 2398 | JBS-2227 | Ac-DQVWWWGPKLRMGLIEYGWE-NH2 | 2439 | JBS-2268 | Ac-DQVWWWGPKARMFLIEYGWE-NH2 |
| 2399 | JBS-2228 | Ac-DQVWWWGPKALMGLIEYGWE-NH2 | 2440 | JBS-2269 | Ac-DQVWWWGPKARMGFIEYGWE-NH2 |
| 2400 | JBS-2229 | Ac-DQVWWWGPKARLGLIEYGWE-NH2 | 2441 | JBS-2270 | Ac-DQVWWWGPKARMGLFEYGWE-NH2 |
| 2401 | JBS-2230 | Ac-DQVWWWGPKARMLLIEYGWE-NH2 | 2442 | JBS-2271 | Ac-DQVWWWGPKARMGLIFYGWE-NH2 |
| 2402 | JBS-2231 | Ac-DQVWWWGPKARMGLLIEYGWE-NH2 | 2443 | JBS-2272 | Ac-DQVWWWGPKARMGLIEFGWE-NH2 |
| 2403 | JBS-2232 | Ac-DQVWWWGPKARMGLILYGWE-NH2 | 2444 | JBS-2273 | Ac-DQVWWWGPKARMGLIEYFWE-NH2 |
| 2404 | JBS-2233 | Ac-DQVWWWGPKARMGLIELGWE-NH2 | 2445 | JBS-2274 | Ac-DQVWWWGPKARMGLIEYGFE-NH2 |
| 2405 | JBS-2234 | Ac-DQVWWWGPKARMGLIEYLWE-NH2 | 2446 | JBS-2275 | Ac-DQVWWWGPKARMGLIEYGWF-NH2 |

FIGURE 2DD

| SEQ ID | Compound | Sequence | SEQ ID | Compound | Sequence |
| --- | --- | --- | --- | --- | --- |
| 2447 | JBS-2276 | Ac-PQVWWWGPKARMGLIEYGWE-NH2 | 2488 | JBS-2317 | Ac-DQVWWGPKAR-NH2 |
| 2448 | JBS-2277 | Ac-DPVWWWGPKARMGLIEYGWE-NH2 | 2489 | JBS-2318 | Ac-WWWGPKARMGLIEYGWE-NH2 |
| 2449 | JBS-2278 | Ac-DQPWWWGPKARMGLIEYGWE-NH2 | 2490 | JBS-2319 | Ac-GPKARMGLIEYGWE-NH2 |
| 2450 | JBS-2279 | Ac-DQVPWWWGPKARMGLIEYGWE-NH2 | 2491 | JBS-2320 | Ac-ARMGLIEYGWE-NH2 |
| 2451 | JBS-2280 | Ac-DQVWPWWGPKARMGLIEYGWE-NH2 | 2492 | JBS-2321 | Ac-WWWGPKARMGLIEY-NH2 |
| 2452 | JBS-2281 | Ac-DQVWWPGPKARMGLIEYGWE-NH2 | 2493 | JBS-2322 | Ac-AEVGWYNVVTQKHSKLGMLI-NH2 |
| 2453 | JBS-2282 | Ac-DQVWWWPPKARMGLIEYGWE-NH2 | 2494 | JBS-2323 | Ac-IAVGWYNVVTQKHSKLGMLI-NH2 |
| 2454 | JBS-2283 | Ac-DQVWWWGPPARMGLIEYGWE-NH2 | 2495 | JBS-2324 | Ac-IEAGWYNVVTQKHSKLGMLI-NH2 |
| 2455 | JBS-2284 | Ac-DQVWWWGPKPRMGLIEYGWE-NH2 | 2496 | JBS-2325 | Ac-IEVAWYNVVTQKHSKLGMLI-NH2 |
| 2456 | JBS-2285 | Ac-DQVWWWGPKAPMGLIEYGWE-NH2 | 2497 | JBS-2326 | Ac-IEVGAYNVVTQKHSKLGMLI-NH2 |
| 2457 | JBS-2286 | Ac-DQVWWWGPKARPGLIEYGWE-NH2 | 2498 | JBS-2327 | Ac-IEVGWANVVTQKHSKLGMLI-NH2 |
| 2458 | JBS-2287 | Ac-DQVWWWGPKARMPLIEYGWE-NH2 | 2499 | JBS-2328 | Ac-IEVGWYAVVTQKHSKLGMLI-NH2 |
| 2459 | JBS-2288 | Ac-DQVWWWGPKARMGPIEYGWE-NH2 | 2500 | JBS-2329 | Ac-IEVGWYNAVTQKHSKLGMLI-NH2 |
| 2460 | JBS-2289 | Ac-DQVWWWGPKARMGLPEYGWE-NH2 | 2501 | JBS-2330 | Ac-IEVGWYNVATQKHSKLGMLI-NH2 |
| 2461 | JBS-2290 | Ac-DQVWWWGPKARMGLIPYGWE-NH2 | 2502 | JBS-2331 | Ac-IEVGWYNVVAQKHSKLGMLI-NH2 |
| 2462 | JBS-2291 | Ac-DQVWWWGPKARMGLIEPGWE-NH2 | 2503 | JBS-2332 | Ac-IEVGWYNVVTAKHSKLGMLI-NH2 |
| 2463 | JBS-2292 | Ac-DQVWWWGPKARMGLIEYPWE-NH2 | 2504 | JBS-2333 | Ac-IEVGWYNVVTQAHSKLGMLI-NH2 |
| 2464 | JBS-2293 | Ac-DQVWWWGPKARMGLIEYGPE-NH2 | 2505 | JBS-2334 | Ac-IEVGWYNVVTQKASKLGMLI-NH2 |
| 2465 | JBS-2294 | Ac-DQVWWWGPKARMGLIEYGWP-NH2 | 2506 | JBS-2335 | Ac-IEVGWYNVVTQKHAKLGMLI-NH2 |
| 2466 | JBS-2295 | Ac-SQVWWWGPKARMGLIEYGWE-NH2 | 2507 | JBS-2336 | Ac-IEVGWYNVVTQKHSALGMLI-NH2 |
| 2467 | JBS-2296 | Ac-DSVWWWGPKARMGLIEYGWE-NH2 | 2508 | JBS-2337 | Ac-IEVGWYNVVTQKHSKAGMLI-NH2 |
| 2468 | JBS-2297 | Ac-DQVWWWGPSARMGLIEYGWE-NH2 | 2509 | JBS-2338 | Ac-IEVGWYNVVTQKHSKLAMLI-NH2 |
| 2469 | JBS-2298 | Ac-DQVSWWWGPKARMGLIEYGWE-NH2 | 2510 | JBS-2339 | Ac-IEVGWYNVVTQKHSKLGALI-NH2 |
| 2470 | JBS-2299 | Ac-DQVWSWGPKARMGLIEYGWE-NH2 | 2511 | JBS-2340 | Ac-IEVGWYNVVTQKHSKLGMAI-NH2 |
| 2471 | JBS-2300 | Ac-DQVWWSGPKARMGLIEYGWE-NH2 | 2512 | JBS-2341 | Ac-IEVGWYNVVTQKHSKLGMLA-NH2 |
| 2472 | JBS-2301 | Ac-DQVWWWSPKARMGLIEYGWE-NH2 | 2513 | JBS-2342 | Ac-DEVGWYNVVTQKHSKLGMLI-NH2 |
| 2473 | JBS-2302 | Ac-DQVWWWGSKARMGLIEYGWE-NH2 | 2514 | JBS-2343 | Ac-IDVGWYNVVTQKHSALGMLI-NH2 |
| 2474 | JBS-2303 | Ac-DQVWWWGPSARMGLIEYGWE-NH2 | 2515 | JBS-2344 | Ac-IEDGWYNVVTQKHSKAGMLI-NH2 |
| 2475 | JBS-2304 | Ac-DQVWWWGPKSRMGLIEYGWE-NH2 | 2516 | JBS-2345 | Ac-IEVDWYNVVTQKHSKLGALI-NH2 |
| 2476 | JBS-2305 | Ac-DQVWWWGPKASMGLIEYGWE-NH2 | 2517 | JBS-2346 | Ac-IEVGDYNVVTQKHSKLGMLI-NH2 |
| 2477 | JBS-2306 | Ac-DQVWWWGPKARSGLIEYGWE-NH2 | 2518 | JBS-2347 | Ac-IEVGWDNVVTQKHSKLGMLI-NH2 |
| 2478 | JBS-2307 | Ac-DQVWWWGPKARMSLIEYGWE-NH2 | 2519 | JBS-2348 | Ac-IEVGWYDVVTQKDSKLGMLI-NH2 |
| 2479 | JBS-2308 | Ac-DQVWWWGPKARMGSIEYGWE-NH2 | 2520 | JBS-2349 | Ac-IEVGWYNDVTQKHSKLGMLI-NH2 |
| 2480 | JBS-2309 | Ac-DQVWWWGPKARMGLSEYGWE-NH2 | 2521 | JBS-2350 | Ac-IEVGWYNVDTQKHSKLGMLI-NH2 |
| 2481 | JBS-2310 | Ac-DQVWWWGPKARMGLISYGWE-NH2 | 2522 | JBS-2351 | Ac-IEVGWYNVVDQKHSKLGMLI-NH2 |
| 2482 | JBS-2311 | Ac-DQVWWWGPKARMGLIESGWE-NH2 | 2523 | JBS-2352 | Ac-IEVGWYNVVTDKHSKLGMLI-NH2 |
| 2483 | JBS-2312 | Ac-DQVWWWGPKARMGLIEYSWE-NH2 | 2524 | JBS-2353 | Ac-IEVGWYNVVTQDHSKLGMLI-NH2 |
| 2484 | JBS-2313 | Ac-DQVWWWGPKARMGLIEYGSE-NH2 | 2525 | JBS-2354 | Ac-IEVGWYNVVTQKDSKLGMLI-NH2 |
| 2485 | JBS-2314 | Ac-DQVWWWGPKARMGLIEYGWS-NH2 | 2526 | JBS-2355 | Ac-IEVGWYNVVTQKHDKLGMLI-NH2 |
| 2486 | JBS-2315 | Ac-DQVWWWGPKARMGLIEY-NH2 | 2527 | JBS-2356 | Ac-IEVGWYNVVTQKHSDLGMLI-NH2 |
| 2487 | JBS-2316 | Ac-DQVWWWGPKARMGL-NH2 | 2528 | JBS-2357 | Ac-IEVGWYNVVTQKHSKDGMLI-NH2 |

| SEQ ID | Compound | Sequence | SEQ ID | Compound | Sequence |
|---|---|---|---|---|---|
| 2529 | JBS-2358 | Ac-IEVGWYNVVTQKHSKLDML I-NH2 | 2570 | JBS-2399 | Ac-IEVGWYNVVTQKHSKLGMLI-NH2 |
| 2530 | JBS-2359 | Ac-IEVGWYNVVTQKHSKLGDLI-NH2 | 2571 | JBS-2400 | Ac-IEKGWYNVVTQKHSKLGMLI-NH2 |
| 2531 | JBS-2360 | Ac-IEVGWYNVVTQKHSKLGMDI-NH2 | 2572 | JBS-2401 | Ac-IEVKWYNVVTQKHSKLGMLI-NH2 |
| 2532 | JBS-2361 | Ac-IEVGWYNVVTQKHSKLGMLD-NH2 | 2573 | JBS-2402 | Ac-IEVGKYNVVTQKHSKLGMLI-NH2 |
| 2533 | JBS-2362 | Ac-GEVGWYNVVTQKHSKLGMLI-NH2 | 2574 | JBS-2403 | Ac-IEVGWKNVVTQKHSKLGMLI-NH2 |
| 2534 | JBS-2363 | Ac-IGVGWYNVVTQKHSKLGMLI-NH2 | 2575 | JBS-2404 | Ac-IEVGWYKVVTQKHSKLGMLI-NH2 |
| 2535 | JBS-2364 | Ac-IEEGWYNVVTQKHSKLGMLI-NH2 | 2576 | JBS-2405 | Ac-IEVGWYNKVTQKHSKLGMLI-NH2 |
| 2536 | JBS-2365 | Ac-IEVGGYNVVTQKHSKLGMLI-NH2 | 2577 | JBS-2406 | Ac-IEVGWYNVKTQKHSKLGMLI-NH2 |
| 2537 | JBS-2366 | Ac-IEVGWGNVVTQKHSKLGMLI-NH2 | 2578 | JBS-2407 | Ac-IEVGWYNVVKQKHSKLGMLI-NH2 |
| 2538 | JBS-2367 | Ac-IEVGWYGVVTQKHSKLGMLI-NH2 | 2579 | JBS-2408 | Ac-IEVGWYNVVTKKHSKLGMLI-NH2 |
| 2539 | JBS-2368 | Ac-IEVGWYNGVTQKHSKLGMLI-NH2 | 2580 | JBS-2409 | Ac-IEVGWYNVVTQKKSKLGMLI-NH2 |
| 2540 | JBS-2369 | Ac-IEVGWYNVGTQKHSKLGMLI-NH2 | 2581 | JBS-2410 | Ac-IEVGWYNVVTQKHKKLGMLI-NH2 |
| 2541 | JBS-2370 | Ac-IEVGWYNVVGQKHSKLGMLI-NH2 | 2582 | JBS-2411 | Ac-IEVGWYNVVTQKHSKKGMLI-NH2 |
| 2542 | JBS-2371 | Ac-IEVGWYNVVTGKHSKLGMLI-NH2 | 2583 | JBS-2412 | Ac-IEVGWYNVVTQKHSKLKMLI-NH2 |
| 2543 | JBS-2372 | Ac-IEVGWYNVVTQGHSKLGMLI-NH2 | 2584 | JBS-2413 | Ac-IEVGWYNVVTQKHSKLGKLI-NH2 |
| 2544 | JBS-2373 | Ac-IEVGWYNVVTQKGSKLGMLI-NH2 | 2585 | JBS-2414 | Ac-IEVGWYNVVTQKHSKLGMKI-NH2 |
| 2545 | JBS-2374 | Ac-IEVGWYNVVTQKHGKLGMLI-NH2 | 2586 | JBS-2415 | Ac-IEVGWYNVVTQKHSKLGMLK-NH2 |
| 2546 | JBS-2375 | Ac-IEVGWYNVVTQKHSGLGMLI-NH2 | 2587 | JBS-2416 | Ac-FEVGWYNVVTQKHSKLGMLI-NH2 |
| 2547 | JBS-2376 | Ac-IEVGWYNVVTQKHSKGGMLI-NH2 | 2588 | JBS-2417 | Ac-IFVGWYNVVTQKHSKLGMLI-NH2 |
| 2548 | JBS-2377 | Ac-IEVGWYNVVTQKHSKLGGLI-NH2 | 2589 | JBS-2418 | Ac-IEFGWYNVVTQKHSKLGMLI-NH2 |
| 2549 | JBS-2378 | Ac-IEVGWYNVVTQKHSKLGMGI-NH2 | 2590 | JBS-2419 | Ac-IEVFWYNVVTQKHSKLGMLI-NH2 |
| 2550 | JBS-2379 | Ac-IEVGWYNVVTQKHSKLGMLG-NH2 | 2591 | JBS-2420 | Ac-IEVGFYNVVTQKHSKLGMLI-NH2 |
| 2551 | JBS-2380 | Ac-LEVGWYNVVTQKHSKLGMLI-NH2 | 2592 | JBS-2421 | Ac-IEVGWFNVVTQKHSKLGMLI-NH2 |
| 2552 | JBS-2381 | Ac-ILVGWYNVVTQKHSKLGMLI-NH2 | 2593 | JBS-2422 | Ac-IEVGWYFVVTQKHSKLGMLI-NH2 |
| 2553 | JBS-2382 | Ac-IELGWYNVVLQKHSKLGMLI-NH2 | 2594 | JBS-2423 | Ac-IEVGWYNFVTQKHFKLGMLI-NH2 |
| 2554 | JBS-2383 | Ac-IEVLWYNVVTLKHSKLGMLI-NH2 | 2595 | JBS-2424 | Ac-IEVGWYNVFTQKHSKLGMLI-NH2 |
| 2555 | JBS-2384 | Ac-IEVGLYNVVTQLHSKLGMLI-NH2 | 2596 | JBS-2425 | Ac-IEVGWYNVVFQKHSKLGMLI-NH2 |
| 2556 | JBS-2385 | Ac-IEVGWLNVVTQKLSKLGMLI-NH2 | 2597 | JBS-2426 | Ac-IEVGWYNVVTFKHSKLGMLI-NH2 |
| 2557 | JBS-2386 | Ac-IEVGWYLVVTQKHLKLGMLI-NH2 | 2598 | JBS-2427 | Ac-IEVGWYNVVTQFHSKLGMLI-NH2 |
| 2558 | JBS-2387 | Ac-IEVGWYNLVTQKHSLLGMLI-NH2 | 2599 | JBS-2428 | Ac-IEVGWYNVVTQKFSKLGMLI-NH2 |
| 2559 | JBS-2388 | Ac-IEVGWYNVLTQKHSKLLMLI-NH2 | 2600 | JBS-2429 | Ac-IEVGWYNVVTQKHFKLGMLI-NH2 |
| 2560 | JBS-2389 | Ac-IEVGWYNVVLQKHSKLGLLI-NH2 | 2601 | JBS-2430 | Ac-IEVGWYNVVTQKHSFLGMLI-NH2 |
| 2561 | JBS-2390 | Ac-IEVGWYNVVTLKHSKLGMLL-NH2 | 2602 | JBS-2431 | Ac-IEVGWYNVVTQKHSKFGMLI-NH2 |
| 2562 | JBS-2391 | Ac-IEVGWYNVVTQLHSKLGMLI-NH2 | 2603 | JBS-2432 | Ac-IEVGWYNVVTQKHSKLFMLI-NH2 |
| 2563 | JBS-2392 | Ac-IEVGWYNVVTQKLSKLGMLI-NH2 | 2604 | JBS-2433 | Ac-IEVGWYNVVTQKHSKLGFLI-NH2 |
| 2564 | JBS-2393 | Ac-IEVGWYNVVTQKHLKLGMLI-NH2 | 2605 | JBS-2434 | Ac-IEVGWYNVVTQKHSKLGMFI-NH2 |
| 2565 | JBS-2394 | Ac-IEVGWYNVVTQKHSLLGMLI-NH2 | 2606 | JBS-2435 | Ac-IEVGWYNVVTQKHSKLGMLF-NH2 |
| 2566 | JBS-2395 | Ac-IEVGWYNVVTQKHSKLLMLI-NH2 | 2607 | JBS-2436 | Ac-PEVGWYNVVTQKHSKLGMLI-NH2 |
| 2567 | JBS-2396 | Ac-IEVGWYNVVTQKHSKLGLLI-NH2 | 2608 | JBS-2437 | Ac-IPVGWYNVVTQKHSFLGMLI-NH2 |
| 2568 | JBS-2397 | Ac-IEVGWYNVVTQKHSKLGLLI-NH2 | 2609 | JBS-2438 | Ac-IEPGWYNVVTQKHSKLGMLI-NH2 |
| 2569 | JBS-2398 | Ac-KEVGWYNVVTQKHSKLGMLI-NH2 | 2610 | JBS-2439 | Ac-IEVPWYNVVTQKHSKLGMLI-NH2 |

FIGURE 2GG

| SEQ ID | Compound | Sequence |
|---|---|---|
| 2611 | JBS-2440 | Ac-IEVGPYNVVTQKHSKLGMLI-NH2 |
| 2612 | JBS-2441 | Ac-IEVGWPNVVTQKHSKLGMLI-NH2 |
| 2613 | JBS-2442 | Ac-IEVGWYPVVTQKHSKLGMLI-NH2 |
| 2614 | JBS-2443 | Ac-IEVGWYNPVTQKHSKLGMLI-NH2 |
| 2615 | JBS-2444 | Ac-IEVGWYNVPTQKHSKLGMLI-NH2 |
| 2616 | JBS-2445 | Ac-IEVGWYNVVPQKHSKLGMLI-NH2 |
| 2617 | JBS-2446 | Ac-IEVGWYNVVTPKHSKLGMLI-NH2 |
| 2618 | JBS-2447 | Ac-IEVGWYNVVTQPHSKLGMLI-NH2 |
| 2619 | JBS-2448 | Ac-IEVGWYNVVTQKPSKLGMLI-NH2 |
| 2620 | JBS-2449 | Ac-IEVGWYNVVTQKHPKLGMLI-NH2 |
| 2621 | JBS-2450 | Ac-IEVGWYNVVTQKHSPLGMLI-NH2 |
| 2622 | JBS-2451 | Ac-IEVGWYNVVTQKHSKPGMLI-NH2 |
| 2623 | JBS-2452 | Ac-IEVGWYNVVTQKHSKLPMLI-NH2 |
| 2624 | JBS-2453 | Ac-IEVGWYNVVTQKHSKLGPLI-NH2 |
| 2625 | JBS-2454 | Ac-IEVGWYNVVTQKHSKLGMPI-NH2 |
| 2626 | JBS-2455 | Ac-IEVGWYNVVTQKHSKLGMLP-NH2 |
| 2627 | JBS-2456 | Ac-SEVGWYNVVTQKHSKLGMLI-NH2 |
| 2628 | JBS-2457 | Ac-ISVGWYNVVTQKHSKLGMLI-NH2 |
| 2629 | JBS-2458 | Ac-IEESGWYNVVTQKHSKLGMLI-NH2 |
| 2630 | JBS-2459 | Ac-IEVSWYNVVTQKHSKLGMLI-NH2 |
| 2631 | JBS-2460 | Ac-IEVGSYNVVTQKHSKLGMLI-NH2 |
| 2632 | JBS-2461 | Ac-IEVGWSNVVTQKHSKLGMLI-NH2 |
| 2633 | JBS-2462 | Ac-IEVGWYSVVTQKHSKLGMLI-NH2 |
| 2634 | JBS-2463 | Ac-IEVGWYNSVTQKHSKLGMLI-NH2 |
| 2635 | JBS-2464 | Ac-IEVGWYNVSTQKHSKLGMLI-NH2 |
| 2636 | JBS-2465 | Ac-IEVGWYNVVSQKHSKLGMLI-NH2 |
| 2637 | JBS-2466 | Ac-IEVGWYNVVTSKHSKLGMLI-NH2 |
| 2638 | JBS-2467 | Ac-IEVGWYNVVTQSHSKLGMLI-NH2 |
| 2639 | JBS-2468 | Ac-IEVGWYNVVTQKSSKLGMLI-NH2 |
| 2640 | JBS-2469 | Ac-IEVGWYNVVTQKHSSKLGMLI-NH2 |
| 2641 | JBS-2471 | Ac-IEVGWYNVVTQKHSKSGMLI-NH2 |
| 2642 | JBS-2472 | Ac-IEVGWYNVVTQKHSKLSMLI-NH2 |
| 2643 | JBS-2473 | Ac-IEVGWYNVVTQKHSKLGSLI-NH2 |
| 2644 | JBS-2474 | Ac-IEVGWYNVVTQKHSKLGMSI-NH2 |
| 2645 | JBS-2475 | Ac-IEVGWYNVVTQKHSKLGMLS-NH2 |
| 2646 | JBS-2476 | Ac-IEVGWYNVVTQKHSKLG-NH2 |
| 2647 | JBS-2477 | Ac-IEVGWYNVVTQKHS-NH2 |
| 2648 | JBS-2478 | Ac-IEVGWYNVVTQ-NH2 |
| 2649 | JBS-2479 | Ac-GWYNVVTQKHSKLGMLI-NH2 |
| 2650 | JBS-2480 | Ac-NVVTQKHSKLGMLI-NH2 |
| 2651 | JBS-2480 | Ac-TQKHSKLGMLI-NH2 |
| 2652 | JBS-2481 | Ac-GWYNVVTQKHSKLG-NH2 |
| 2653 | JBS-2483 | Bio-Ttds-KLYLWQRWPSPWVEVGWEFV-NH2 |
| 2654 | JBS-2485 | Bio-Ttds-HKYLWQRWPSPWVEVGWEFV-NH2 |
| 2655 | JBS-2487 | Bio-Ttds-HAYLWQAWPSPWVEVGWEFV-NH2 |
| 2656 | JBS-2489 | Bio-Ttds-HLYLWQSMPSPWVEVGWEFV-NH2 |
| 2657 | JBS-2491 | Bio-Ttds-HLYLWQRAPSPWVEVGWEFV-NH2 |
| 2658 | JBS-2493 | Bio-Ttds-HLYLWQRFPSPWVEVGWEFV-NH2 |
| 2659 | JBS-2495 | Bio-Ttds-HLYLWQRMPSPFVEVGWEFV-NH2 |
| 2660 | JBS-2497 | Bio-Ttds-HLYLWQRMPSPGVEVGWEFV-NH2 |
| 2661 | JBS-2499 | Ac-KKYLWQAAPSPGVEVGWEFV-NH2 |
| 2662 | JBS-2500 | Bio-Ttds-KKYLWQAAPSPGVEVGWEFV-NH2 |
| 2663 | JBS-2501 | Ac-IPDQCCSPLPCNEDGYMSCKDGKASFTCT-NH2 |
| 2664 | JBS-2502 | Ac-VYEVGWDHGNWDEIIWR-NH2 |
| 2665 | JBS-2503 | Ac-VYEVGWDHGNWSEIIWR-NH2 |
| 2666 | JBS-2504 | Ac-VYEVGWDHGDWYEIIWR-NH2 |
| 2667 | JBS-2505 | Ac-VGWDHGNWDEIIWR-NH2 |
| 2668 | JBS-2506 | Ac-VGWDHGNWSEIIWR-NH2 |
| 2669 | JBS-2507 | Ac-VGWDHGDWYEIIWR-NH2 |
| 2670 | JBS-2508 | Ac-WWWGPKAPMGLIEYGWE-NH2 |
| 2671 | JBS-2509 | Ac-WWWGPKARMGLIEYGWL-NH2 |
| 2672 | JBS-2510 | Ac-WWWGPKARMGLLSYGWE-NH2 |
| 2673 | JBS-2511 | Ac-GFVWEDLWGTVEIWIWTKKT-NH2 |
| 2674 | JBS-2675 | Bio-Ttds-MKIIVGWELFDTGETLWWKV-NH2 |
| 2675 | JBS-2690 | Bio-Ttds-VYEVGWDHGNWDEIIWRYPS-NH2 |
| 2676 | JBS-2691 | Bio-Ttds-VYEVGWDHGNWYEIIWRDPS-NH2 |
| 2677 | JBS-2692 | Bio-Ttds-YTVEVGWHTVHTGRDNYFWM-NH2 |
| 2678 | JBS-2693 | Bio-Ttds-YTVEVGWHTVHTGRDNPMWM-NH2 |
| 2679 | JBS-2694 | Bio-Ttds-VYEVGWDHGDWYEIIWR-NH2 |
| 2680 | JBS-2695 | Bio-Ttds-HKYLWQRWPSPWVEVGWEFV-NH2 |
| 2681 | JBS-2700 | Bio-Ttds-HKYLWQRWPSPWVEVGWDHGNWYEIIWRDPS-NH2 |
| 2682 | JBS-2702 | Ac-HKYLWQRWPSPWVEVGWDHGNWYEIIWRDPS-NH2 |
| 2683 | JBS-2703 | Bio-Ttds-HKYLWQRWPSPWVEVGWDHGNWYFIIWRDPS-NH2 |
| 2684 | JBS-2704 | Ac-HKYLWQRWPSPLVSAGWYDYNFDHYREFT-NH2 |
| 2685 | JBS-2705 | Bio-Ttds-HKYLWQRWPSPLVSAGWYDYNFDHYREFT-NH2 |
| 2686 | JBS-2706 | Ac-HKYLWQRWPSPLVEVGWYDYNFDHYREFT-NH2 |
| 2687 | JBS-2707 | Bio-Ttds-HKYLWQRWPSPLVEVGWYDYNFDHYREFT-NH2 |
| 2688 | JBS-2708 | Ac-HLYLWQAWPSPWVEVGWDHGNWYEIIWRDPS-NH2 |
| 2689 | JBS-2709 | Bio-Ttds-HLYLWQAWPSPWVEVGWDHGNWYEIIWRDPS-NH2 |
| 2690 | JBS-2710 | Ac-HLYLWQAWPSPLVSAGWYDYNFDHYREFT-NH2 |
| 2691 | JBS-2711 | Bio-Ttds-HLYLWQAWPSPLVSAGWYDYNFDHYREFT-NH2 |
| 2692 | JBS-2711 | Ac-HLYLWQAWPSPLVEVGWYDYNFDHYREFT-NH2 |

| SEQ ID | Compound | Sequence | SEQ ID | Compound | Sequence |
|---|---|---|---|---|---|
| 2693 | JBS-2712 | Bio-Ttds-HLYLMQAWPSPLVEVGWYDYNFDHYREFT-NH2 | 2734 | JBS-2979 | Ac-HLYLMQAWPSPWVEVGWHFV-NH2 |
| 2694 | JBS-2715 | Ac-VYEVGWDHGNWYEIIWRDPSC(ME-400MA)-NH2 | 2735 | JBS-2980 | Ac-HLYLMQAWPSPWVEVGWEEV-NH2 |
| 2695 | JBS-2716 | Ac-C(ME-400MA)-VYEVGWDHGNWYEIIWRDPS-NH2 | 2736 | JBS-2981 | Ac-HLYLMQAWPSPWVEVGWEFH-NH2 |
| 2696 | JBS-2717 | Ac-NCSLDNGGCTHYCLEEVGWRRCS-NH2 | 2737 | JBS-2982 | Ac-ILYLMQAWPSPWVEVGWEFV-NH2 |
| 2697 | JBS-2718 | Bio-Ttds-NCSLDNGGCTHYCLEEVGWRRCS-NH2 | 2738 | JBS-2983 | Ac-HIYLMQAWPSPWVEVGWEFV-NH2 |
| 2698 | JBS-2719 | Ac-GCTHYSLEEVGWRRCS-NH2 | 2739 | JBS-2984 | Ac-HLILMQAWPSPWVEVGWEFV-NH2 |
| 2699 | JBS-2720 | Bio-Ttds-GCTHYSLEEVGWRRCS-NH2 | 2740 | JBS-2985 | Ac-HLYIMQAWPSPWVEVGWEFV-NH2 |
| 2700 | JBS-2945 | Ac-HLYLMQAWPSPWVEVGWEFV-NH2 | 2741 | JBS-2986 | Ac-HLYLIQAWPSPWVEVGWEFV-NH2 |
| 2701 | JBS-2946 | Ac-HEYLMQAWPSPWVEVGWEFV-NH2 | 2742 | JBS-2987 | Ac-HLYLMIAWPSPWVEVGWEFV-NH2 |
| 2702 | JBS-2947 | Ac-HLELMQAWPSPWVEVGWEFV-NH2 | 2743 | JBS-2988 | Ac-HLYLMQIWPSPWVEVGWEFV-NH2 |
| 2703 | JBS-2948 | Ac-HLYEWQAWPSPWVEVGWEFV-NH2 | 2744 | JBS-2989 | Ac-HLYLMQAIPSPWVEVGWEFV-NH2 |
| 2704 | JBS-2949 | Ac-HLYLEQAWPSPWVEVGWEFV-NH2 | 2745 | JBS-2990 | Ac-HLYLMQAWISPWVEVGWEFV-NH2 |
| 2705 | JBS-2950 | Ac-HLYLWEAWPSPWVEVGWEFV-NH2 | 2746 | JBS-2991 | Ac-HLYLMQAWPIPWVEVGWEFV-NH2 |
| 2706 | JBS-2951 | Ac-HLYLMQEWPSPWVEVGWEFV-NH2 | 2747 | JBS-2992 | Ac-HLYLMQAWPSIWVEVGWEFV-NH2 |
| 2707 | JBS-2952 | Ac-HLYLMQAEPSPWVEVGWEFV-NH2 | 2748 | JBS-2993 | Ac-HLYLMQAWPSPTVEVGWEFV-NH2 |
| 2708 | JBS-2953 | Ac-HLYLMQAWESPWVEVGWEFV-NH2 | 2749 | JBS-2994 | Ac-HLYLMQAWPSPWIEVGWEFV-NH2 |
| 2709 | JBS-2954 | Ac-HLYLMQAWPEPWVEVGWEEV-NH2 | 2750 | JBS-2995 | Ac-HLYLMQAWPSPWVIVGWEFV-NH2 |
| 2710 | JBS-2955 | Ac-HLYLMQAWPSEWVEVGWEFE-NH2 | 2751 | JBS-2996 | Ac-HLYLMQAWPSPWVEIGWEFV-NH2 |
| 2711 | JBS-2956 | Ac-HLYLMQAWPSPEVEVGWEFV-NH2 | 2752 | JBS-2997 | Ac-HLYLMQAWPSPWVEVIWEFV-NH2 |
| 2712 | JBS-2957 | Ac-HLYLMQAWPSPWEEVGWEFV-NH2 | 2753 | JBS-2998 | Ac-HLYLMQAWPSPWVEVGIEFV-NH2 |
| 2713 | JBS-2958 | Ac-HLYLMQAWPSPWVEEGWEFV-NH2 | 2754 | JBS-2999 | Ac-HLYLMQAWPSPWVEVGWIFV-NH2 |
| 2714 | JBS-2959 | Ac-HLYLMQAWPSPWVEVEWEFV-NH2 | 2755 | JBS-3000 | Ac-HLYLMQAWPSPWVEVGWETV-NH2 |
| 2715 | JBS-2960 | Ac-HLYLMQAWPSPWVEVGEEFV-NH2 | 2756 | JBS-3001 | Ac-HLYLMQAWPSPWVEVGWEFI-NH2 |
| 2716 | JBS-2961 | Ac-HLYLMQAWPSPWVEVGWEEV-NH2 | 2757 | JBS-3002 | Ac-MLYLMQAWPSPWVEVGWEFV-NH2 |
| 2717 | JBS-2962 | Ac-HLYLMQAWPSPWVEVGWEFE-NH2 | 2758 | JBS-3003 | Ac-HMYLMQAWPSPWVEIGWEFV-NH2 |
| 2718 | JBS-2963 | Ac-HHYLMQAWPSPWVEVGWEFV-NH2 | 2759 | JBS-3004 | Ac-HLMLMQAWPSPWVMSPWVEVGWEFV-NH2 |
| 2719 | JBS-2964 | Ac-HLHLMQAWPSPWVEVGWEFV-NH2 | 2760 | JBS-3005 | Ac-HLYMMQAWPMPWVEVGWEFV-NH2 |
| 2720 | JBS-2965 | Ac-HLYHMQAWPSPWVEVGWEFV-NH2 | 2761 | JBS-3006 | Ac-HLYLMMAWPSMWVEVGWEFV-NH2 |
| 2721 | JBS-2966 | Ac-HLYLHQAWPSPWVEVGWEFV-NH2 | 2762 | JBS-3007 | Ac-HLYLMMAWPSPWVEVGWEFV-NH2 |
| 2722 | JBS-2967 | Ac-HLYLWHAWPSPWVEVGWEFV-NH2 | 2763 | JBS-3008 | Ac-HLYLMQMWPSPWVEVGWEFV-NH2 |
| 2723 | JBS-2968 | Ac-HLYLWQHWPSPWVEVGWEFV-NH2 | 2764 | JBS-3009 | Ac-HLYLMQAMPSPWVEVGWEFV-NH2 |
| 2724 | JBS-2969 | Ac-HLYLWQAHPSPWVEVGWEFV-NH2 | 2765 | JBS-3010 | Ac-HLYLMQAWMSPWVEVGWEFV-NH2 |
| 2725 | JBS-2970 | Ac-HLYLWQAWHSPWVEVGWEFV-NH2 | 2766 | JBS-3011 | Ac-HLYLMQAWPMPWVEVGWEFV-NH2 |
| 2726 | JBS-2971 | Ac-HLYLWQAWPHPWVEVGWEFV-NH2 | 2767 | JBS-3012 | Ac-HLYLMQAWPSMWVEVGWEFV-NH2 |
| 2727 | JBS-2972 | Ac-HLYLWQAWPSHWVEVGWEFV-NH2 | 2768 | JBS-3013 | Ac-HLYLMQAWPSPMVEVGWEFV-NH2 |
| 2728 | JBS-2973 | Ac-HLYLWQAWPSPHVEVGWEFV-NH2 | 2769 | JBS-3014 | Ac-HLYLMQAWPSPWMEVGWEFV-NH2 |
| 2729 | JBS-2974 | Ac-HLYLWQAWPSPWHEVGWEFV-NH2 | 2770 | JBS-3015 | Ac-HLYLMQAWPSPWVMVGWEFV-NH2 |
| 2730 | JBS-2975 | Ac-HLYLWQAWPSPWVHVGWEFV-NH2 | 2771 | JBS-3016 | Ac-HLYLMQAWPSPWVEMGWEFV-NH2 |
| 2731 | JBS-2976 | Ac-HLYLWQAWPSPWVEHGWEFV-NH2 | 2772 | JBS-3017 | Ac-HLYLMQAWPSPWVEVMWEFV-NH2 |
| 2732 | JBS-2977 | Ac-HLYLWQAWPSPWVEVHWEFV-NH2 | 2773 | JBS-3018 | Ac-HLYLMQAWPSPWVEVGMEFV-NH2 |
| 2733 | JBS-2978 | Ac-HLYLMQAWPSPWVEVGHEFV-NH2 | 2774 | JBS-3019 | Ac-HLYLMQAWPSPWVEVGWMFV-NH2 |

FIGURE 2HH

| SEQ ID | Compound | Sequence | SEQ ID | Compound | Sequence |
|---|---|---|---|---|---|
| 2775 | JBS-3020 | Ac-HLYLMQAWPSPWVEVGWEMV-NH2 | 2816 | JBS-3061 | Ac-RLYLMQAWPSPWVEVGWEFV-NH2 |
| 2776 | JBS-3021 | Ac-HLYLMQAWPSPWVEVGWEFM-NH2 | 2817 | JBS-3062 | Ac-HRYLMQAWPSPWVEVGWEFV-NH2 |
| 2777 | JBS-3022 | Ac-NLYLMQAWPSPWVEVGWEFV-NH2 | 2818 | JBS-3063 | Ac-HLRLMQAWPSPWVEVGWEFV-NH2 |
| 2778 | JBS-3023 | Ac-HNYLMQAWPSPWVEVGWEFV-NH2 | 2819 | JBS-3064 | Ac-HLYRMQAWPSPWVEVGWEFV-NH2 |
| 2779 | JBS-3024 | Ac-HLNLMQAWPSPWVEVGWEFV-NH2 | 2820 | JBS-3065 | Ac-HLYLRQAWPSPWVEVGWEFV-NH2 |
| 2780 | JBS-3025 | Ac-HLYNMQAWPSPWVEVGWEFV-NH2 | 2821 | JBS-3066 | Ac-HLYLWRAWPSPWVEVGWEFV-NH2 |
| 2781 | JBS-3026 | Ac-HLYLNQAWPSPWVEVGWEFV-NH2 | 2822 | JBS-3067 | Ac-HLYLMQARPSPWVEVGWEFV-NH2 |
| 2782 | JBS-3027 | Ac-HLYLMNAWPSPWVEVGWEFV-NH2 | 2823 | JBS-3068 | Ac-HLYLMQAVRSPWVEVGWEFV-NH2 |
| 2783 | JBS-3028 | Ac-HLYLMQNWPSPWVEVGWEFV-NH2 | 2824 | JBS-3069 | Ac-HLYLMQAWPRPWVEVGWEFV-NH2 |
| 2784 | JBS-3029 | Ac-HLYLMQAWPSPWVEVGWEFV-NH2 | 2825 | JBS-3070 | Ac-HLYLMQAWPSRWVEVGWEFV-NH2 |
| 2785 | JBS-3030 | Ac-HLYLMQAWNSPWVEVGWEFV-NH2 | 2826 | JBS-3071 | Ac-HLYLMQAWPSPRVEVGWEFV-NH2 |
| 2786 | JBS-3031 | Ac-HLYLMQAWPNPWVEVGWEFV-NH2 | 2827 | JBS-3072 | Ac-HLYLMQAWPSPWREVGWEFV-NH2 |
| 2787 | JBS-3032 | Ac-HLYLMQAWPSNWVEVGWEFV-NH2 | 2828 | JBS-3073 | Ac-HLYLMQAWPSPWVRVGWEFV-NH2 |
| 2788 | JBS-3033 | Ac-HLYLMQAWPSPNVEVGWEFV-NH2 | 2829 | JBS-3074 | Ac-HLYLMQAWPSPWVERGWEFV-NH2 |
| 2789 | JBS-3034 | Ac-HLYLMQAWPSNWNEVGWEFV-NH2 | 2830 | JBS-3075 | Ac-HLYLMQAWPSPWVEVRWEFV-NH2 |
| 2790 | JBS-3035 | Ac-HLYLMQAWPSPWVNVGWEFV-NH2 | 2831 | JBS-3076 | Ac-HLYLMQAWPSPWVEVGREFV-NH2 |
| 2791 | JBS-3036 | Ac-HLYLMQAWPSPWVENGWEFV-NH2 | 2832 | JBS-3077 | Ac-HLYLMQAWPSPWVEVGWRFV-NH2 |
| 2792 | JBS-3037 | Ac-HLYLMQAWPSPWVEVNWEFV-NH2 | 2833 | JBS-3078 | Ac-HLYLMQAWPSPWVEVGWERV-NH2 |
| 2793 | JBS-3038 | Ac-HLYLMQAWPSPWVEVGNEFV-NH2 | 2834 | JBS-3079 | Ac-HLYLMQAWPSPWVEVGWEFR-NH2 |
| 2794 | JBS-3039 | Ac-HLYLMQAWPSPWVEVGWNFV-NH2 | 2835 | JBS-3080 | Ac-TLYLMQAWPSPWVEVGWEFV-NH2 |
| 2795 | JBS-3040 | Ac-HLYLMQAWPSPWVEVGWENV-NH2 | 2836 | JBS-3081 | Ac-HTYLMQAWPSPWVEVGWEFV-NH2 |
| 2796 | JBS-3041 | Ac-HLYLMQAWPSPWVEVGWEFN-NH2 | 2837 | JBS-3082 | Ac-HLTLMQAWPSPWVEVGWEFV-NH2 |
| 2797 | JBS-3042 | Ac-QLYLMQAWPSPWVEVGWEFV-NH2 | 2838 | JBS-3083 | Ac-HLYTMQAWPSPWVEVGWEFV-NH2 |
| 2798 | JBS-3043 | Ac-HQYLMQAWPSPWVEVGWEFV-NH2 | 2839 | JBS-3084 | Ac-HLYLTQAWPSPWVEVGWEFV-NH2 |
| 2799 | JBS-3044 | Ac-HLQLMQAWPSPWVEVGWEFV-NH2 | 2840 | JBS-3085 | Ac-HLYLMQAWPTPWVEVGWEFV-NH2 |
| 2800 | JBS-3045 | Ac-HLYQMQAWPSPWVEVGWEFV-NH2 | 2841 | JBS-3086 | Ac-HLYLWTAWPSPWVEVGWEFV-NH2 |
| 2801 | JBS-3046 | Ac-HLYLQQAWPSPWVEVGWEFV-NH2 | 2842 | JBS-3087 | Ac-HLYLMQTWPSPWVEVGWEFV-NH2 |
| 2802 | JBS-3047 | Ac-HLYLMQQWPSPWVEVGWEFV-NH2 | 2843 | JBS-3088 | Ac-HLYLMQATPSPWVEVGWEFV-NH2 |
| 2803 | JBS-3048 | Ac-HLYLMQAQPSPWVEVGWEFV-NH2 | 2844 | JBS-3089 | Ac-HLYLMQAWTPWVEVGWEFV-NH2 |
| 2804 | JBS-3049 | Ac-HLYLMQAWQSPWVEVGWEFV-NH2 | 2845 | JBS-3090 | Ac-HLYLMQAWPTPWVEVGWEFV-NH2 |
| 2805 | JBS-3050 | Ac-HLYLMQAWPQPWVEVGWEFV-NH2 | 2846 | JBS-3091 | Ac-HLYLMQAWPSTWVEVGWEFV-NH2 |
| 2806 | JBS-3051 | Ac-HLYLMQAWPSQWVEVGWEFV-NH2 | 2847 | JBS-3092 | Ac-HLYLMQAWPSPTVEVGWEFV-NH2 |
| 2807 | JBS-3052 | Ac-HLYLMQAWPSPQVEVGWEFV-NH2 | 2848 | JBS-3093 | Ac-HLYLMQAWPSPWTEVGWEFV-NH2 |
| 2808 | JBS-3053 | Ac-HLYLMQAWPSPWQEVGWEFV-NH2 | 2849 | JBS-3094 | Ac-HLYLMQAWPSPWVTVGWEFV-NH2 |
| 2809 | JBS-3054 | Ac-HLYLMQAWPSPWVQVGWEFV-NH2 | 2850 | JBS-3095 | Ac-HLYLMQAWPSPWVETGWEFV-NH2 |
| 2810 | JBS-3055 | Ac-HLYLMQAWPSPWVEQGWEFV-NH2 | 2851 | JBS-3096 | Ac-HLYLMQAWPSPWVEVTWEFV-NH2 |
| 2811 | JBS-3056 | Ac-HLYLMQAWPSPWVEVQWEFV-NH2 | 2852 | JBS-3097 | Ac-HLYLMQAWPSPWVEVGTEFV-NH2 |
| 2812 | JBS-3057 | Ac-HLYLMQAWPSPWVEVGQFV-NH2 | 2853 | JBS-3098 | Ac-HLYLMQAWPSPWVEVGWTFV-NH2 |
| 2813 | JBS-3058 | Ac-HLYLMQAWPSPWVEVGWQFV-NH2 | 2854 | JBS-3099 | Ac-HLYLMQAWPSPWVEVGWEFT-NH2 |
| 2814 | JBS-3059 | Ac-HLYLMQAWPSPWVEVGWEQV-NH2 | 2855 | JBS-3100 | Ac-VLYLMQAWPSPWVEVGWEFV-NH2 |
| 2815 | JBS-3060 | Ac-HLYLMQAWPSPWVEVGWEFQ-NH2 | 2856 | JBS-3101 | Ac-HVYLMQAWPSPWVEVGWEFV-NH2 |

| SEQ ID | Compound | Sequence |
|---|---|---|
| 2857 | JBS-3102 | Ac-HLYLMQAWPSPWVEVGWEFV-NH2 |
| 2858 | JBS-3103 | Ac-HLYLVQAWPSPWVEVGWEFV-NH2 |
| 2859 | JBS-3104 | Ac-HLYLLVQAWPSPWVEVGWEFV-NH2 |
| 2860 | JBS-3105 | Ac-HLYLWAWPSPWVEVGWEFV-NH2 |
| 2861 | JBS-3106 | Ac-HLYLMQVWPSPWVEVGWEFV-NH2 |
| 2862 | JBS-3107 | Ac-HLYLMQAVPSPWVEVGWEFV-NH2 |
| 2863 | JBS-3108 | Ac-HLYLMQAWVSPWVEVGWEFV-NH2 |
| 2864 | JBS-3109 | Ac-HLYLMQAWPVPWVEVGWEFV-NH2 |
| 2865 | JBS-3110 | Ac-HLYLMQAWPSVWVEVGWEFV-NH2 |
| 2866 | JBS-3111 | Ac-HLYLMQAWPSPVVEVGWEFV-NH2 |
| 2867 | JBS-3112 | Ac-HLYLMQAWPSPWVEVGWEFV-NH2 |
| 2868 | JBS-3113 | Ac-HLYLMQAWPSPWVEVVWEFV-NH2 |
| 2869 | JBS-3114 | Ac-HLYLMQAWPSPWVEVGVEFV-NH2 |
| 2870 | JBS-3115 | Ac-HLYLMQAWPSPWVEVGWVFV-NH2 |
| 2871 | JBS-3116 | Ac-HLYLMQAWPSPWVEVGWEVV-NH2 |
| 2872 | JBS-3117 | Ac-MLYLMQAWPSPWVEVGWEFV-NH2 |
| 2873 | JBS-3118 | Ac-HWYLMQAWPSPWVEVGWEFV-NH2 |
| 2874 | JBS-3119 | Ac-HLWLMQAWPSPWVEVGWEFV-NH2 |
| 2875 | JBS-3120 | Ac-HLYWMQAWPSPWVEVGWEFV-NH2 |
| 2876 | JBS-3121 | Ac-HLYLWAWPSPWVEVGWEFV-NH2 |
| 2877 | JBS-3122 | Ac-HLYLMQWWPSPWVEVGWEFV-NH2 |
| 2878 | JBS-3123 | Ac-HLYLMQAWWSPWVEVGWEFV-NH2 |
| 2879 | JBS-3124 | Ac-HLYLMQAWPWPWVEVGWEFV-NH2 |
| 2880 | JBS-3125 | Ac-HLYLMQAWPSWWVEVGWEFV-NH2 |
| 2881 | JBS-3126 | Ac-HLYLMQAWPSPWMVEVGWEFV-NH2 |
| 2882 | JBS-3127 | Ac-HLYLMQAWPSPWWVEVGWEFV-NH2 |
| 2883 | JBS-3128 | Ac-YLYLMQAWPSPWVEVGWEFV-NH2 |
| 2884 | JBS-3129 | Ac-HYYLMQAWPSPWVEVGWEFV-NH2 |
| 2885 | JBS-3130 | Ac-HLYLYQAWPSPWVEVGWEFV-NH2 |
| 2886 | JBS-3131 | Ac-HLYLMQAYPSPWVEVGWEFV-NH2 |
| 2887 | JBS-3132 | Ac-HLYLMQYWPSPWVEVGWEFV-NH2 |
| 2888 | JBS-3133 | Ac-HLYLMQAWYPSPWVEVGWEFV-NH2 |
| 2889 | JBS-3134 | Ac-HLYLMQAWPYPWVEVGWEFV-NH2 |
| 2890 | JBS-3135 | Ac-HLYLMQAWPSYWVEVGWEFV-NH2 |
| 2891 | JBS-3136 | Ac-HLYLYQAWPSPWVEVGWEFV-NH2 |
| 2892 | JBS-3137 | Ac-HLYLMQAWPSPYVEVGWEFV-NH2 |
| 2893 | JBS-3138 | Ac-HLYLMQYWPSPWVEVGWEFV-NH2 |
| 2894 | JBS-3139 | Ac-HLYLMQAYPSPWVEVGWEFV-NH2 |
| 2895 | JBS-3140 | Ac-HLYLMQAWYPSPWVEVGWEFV-NH2 |
| 2896 | JBS-3141 | Ac-HLYLMQAWPYPWVEVGWEFV-NH2 |
| 2897 | JBS-3142 | Ac-HLYLMQAWPSYWVEVGWEFV-NH2 |
| 2898 | JBS-3143 | Ac-HLYLMQAWPSPYVEVGWEFV-NH2 |
| 2899 | JBS-3144 | Ac-HLYLMQAWPSPWYEVGWEFV-NH2 |
| 2900 | JBS-3145 | Ac-HLYLMQAWPSPWVYVGWEFV-NH2 |
| 2901 | JBS-3146 | Ac-HLYLMQAWPSPWVEYGWEFV-NH2 |
| 2902 | JBS-3147 | Ac-HLYLMQAWPSPWVEVYWEFV-NH2 |
| 2903 | JBS-3148 | Ac-HLYLMQAWPSPWVEVGYEFV-NH2 |
| 2904 | JBS-3149 | Ac-HLYLMQAWPSPWVEVGWYFV-NH2 |
| 2905 | JBS-3150 | Ac-HLYLMQAWPSPWVEVGWEYV-NH2 |
| 2906 | JBS-3151 | Ac-HLYLMQAWPSPWVEVGWEFY-NH2 |
| 2907 | JBS-3154 | Ac-VYEVGWDHGNWYEIIWRDPSC(NEM)-NH2 |
| 2908 | JBS-3155 | Ac-C(NEM)-VYEVGWDHGNWYEIIWRDPS-NH2 |
| 2909 | JBS-3183 | Ac-HKYLMQAWPSPWVEVGWEFV-NH2 |
| 2910 | JBS-3184 | Ac-HPYLMQAWPSPWVEVGWEFV-NH2 |
| 2911 | JBS-3209 | Ac-HTYLMQAHPSPNVEVGWEFV-NH2 |
| 2912 | JBS-3210 | Ac-HTYLMQAHPSPEVEVGWEFV-NH2 |
| 2913 | JBS-3211 | Ac-HTYLMQAYPSPNVEVGWEFV-NH2 |
| 2914 | JBS-3212 | Ac-HTYLMQAYPSPEVEVGWEFV-NH2 |
| 2915 | JBS-3213 | Ac-HTYLMQAHPSPEVEVGYEFV-NH2 |
| 2916 | JBS-3214 | Ac-QTYLMQAHPSPEVEVGYEFV-NH2 |

PEPTIDES AND METHODS OF USE

CROSS-REFERENCE TO RELATED APPLICATION

This application claims priority to U.S. Provisional Patent Application No. 61/946,103, filed Feb. 28, 2014, which is incorporated by reference herein in its entirety.

TECHNICAL FIELD OF THE INVENTION

The invention generally relates to peptides that bind Protein S and uses thereof.

INCORPORATION BY REFERENCE

Incorporated by reference in its entirety is a computer-readable nucleotide/amino acid sequence listing submitted concurrently herewith and identified as follows: ASCII text file named "46380A_SeqListing.txt," 1,390,466 bytes, created Feb. 27, 2015.

BACKGROUND OF THE INVENTION

Hemostasis relies on the complex coagulation cascade, wherein a series of events mediated by blood clotting factors leads to conversion of prothrombin to thrombin. Factor X (FX) activation is the central event of both the intrinsic and extrinsic pathways of the coagulation cascade. The extrinsic pathway has been proposed as the primary activator of the coagulation cascade (Mackman et al., *Arterioscler. Thromb. Casc. Biol.*, 27, 1687-1693 (2007)). Circulating Tissue Factor (TF) and activated Factor VII (FVIIa) interact to form the "extrinsic complex," which mediates activation of FX. The coagulation cascade is amplified by the intrinsic pathway, during which successive activation of factors XII, XI, IX, and VIII results in formation of the "intrinsic" FIXa-FVIIIa complex that also mediates FX activation. Activated FX promotes thrombin formation, which is required for the body to create fibrin and effectively curb bleeding. Coagulation is down-regulated by the Protein C-mediated anticoagulant pathway. Thrombin in complex with thrombomodulin activates Protein C. Activated Protein C with its co-factor, Protein S, degrades and inactivates activated blood factors V (FVa) and VIII (FVIIIa).

Severe bleeding disorders, such as hemophilia, result from disruption of the blood coagulation cascade. Factor replacement therapy is the most common treatment for blood coagulation disorders. However, blood clotting factors typically are cleared from the bloodstream shortly after administration. To be effective, a patient must receive frequent intravenous infusions of plasma-derived or recombinant factor concentrates, which is uncomfortable, is expensive, and is time consuming. In addition, therapeutic efficacy of factor replacement therapy can diminish drastically upon formation of inhibitory antibodies. Few therapeutic options exist for patients with anti-Factor antibodies.

SUMMARY OF THE INVENTION

The invention includes, for example, a peptide comprising an amino acid sequence at least 50% identical to the amino acid sequence VSAGWYDYNTDTYYEF (SEQ ID NO: 2920) and comprising the structure of Formula I: X1004-X1005-X1006-X1007-X1008-X1009-X1010-X1011-X1012-X1013-X1014-X1015-X1016-X1017-X1018-X1019, wherein X1004 is A, C, D, E, F, G, H, I, K, L, M, N, P, p, Q, R, S, T, Tle, V, v, W, or Y; wherein X1005 is A, C, D, Dap, E, F, G, H, I, K, L, M, N, P, p, Q, R, S, s, T, V, W, or Y; wherein X1006 is A, a, Aib, C, D, E, F, G, H, I, K, L, M, N, P, p, Q, R, S, s, T, Tle, V, W, or Y; wherein X1007 is A, a, Aib, C, D, E, F, G, H, I, K, L, M, N, Nmg, P, p, Q, R, S, s, T, Tle, V, W, or Y; wherein X1008 is 1Ni, 2Ni, A, Bta, C, D, E, F, G, H, I, K, L, M, N, P, p, Q, R, S, T, V, W, w, or Y; wherein X1009 is A, C, D, E, F, G, H, I, K, L, M, N, P, p, Q, R, S, T, V, W, Y, or w; wherein X1010 is A, C, D, d, E, F, G, H, I, K, L, M, N, P, p, Q, R, S, T, V, W, w, or Y; wherein X1011 is A, C, D, E, F, G, H, I, K, L, M, N, P, p, Q, R, S, T, V, W, Y, or w; wherein X1012 is A, C, D, E, F, G, H, I, K, L, M, N, n, P, p, Q, R, S, T, V, W, or Y; wherein X1013 is A, a, C, D, E, F, G, H, I, K, L, M, N, P, p, Q, R, S, T, t, V, W, or Y; wherein X1014 is A, C, D, d, E, F, G, H, I, K, L, M, N, P, p, Q, R, S, T, V, W, or Y; wherein X1015 is A, C, D, E, F, G, H, I, K, L, M, N, P, p, Q, R, S, T, t, Tle, V, W, or Y; wherein X1016 is A, C, D, E, F, G, H, I, K, L, M, N, P, p, Q, R, S, T, V, W, or Y; wherein X1017 is A, C, D, E, F, G, H, I, K, L, M, N, Nle, P, p, Q, R, S, T, V, W, Y, or y; wherein X1018 is A, C, D, E, e, F, G, H, I, K, L, M, N, P, p, Q, R, S, T, V, W, or Y; and wherein X1019 is A, C, D, E, F, f, G, H, I, K, L, M, N, P, p, Q, R, S, T, V, W, or Y (SEQ ID NO: 2921). In various embodiments, the peptide further comprises one or more N-terminal amino acid(s) directly linked to X1004, wherein the N-terminal amino acid(s) comprise the amino acid sequence selected from the group consisting of X1003, X1002-X1003, and X1001-X1002-X1003. In this regard, X1003 is A, C, D, E, F, G, H, I, K, L, M, N, P, p, Q, R, S, T, Tle, V, W, Y, or y; X1002 is A, C, D, E, F, G, H, I, K, L, M, N, P, p, Q, R, S, T, V, W, Y, or y; and X1001 is A, Bpa, C, D, E, e, F, G, H, I, K, L, M, N, P, p, Q, R, S, T, V, W, or Y (SEQ ID NO: 2922). Alternatively or in addition, the peptide may comprise a C-terminal amino acid directly linked to X1019 and selected from the group consisting of A, C, D, E, e, F, G, H, I, K, L, M, N, P, p, Q, R, S, T, V, W, and Y (SEQ ID NO: 2923). For example, in various embodiments, the peptide comprises an amino acid sequence at least about 80% identical to EYYVSAGWYDYNTDTYYEFE (SEQ ID NO: 2924). The invention includes a peptide comprising (or consisting of) an amino acid sequence selected from the group consisting of SEQ ID NOs: 1-2916, 2920, and 2924.

In addition, the invention provides methods of using the peptide(s) of the invention. For example, the invention provides a method for inhibiting Protein S activity in a subject. A method of treating a subject suffering from a disease or being at risk of suffering from a disease also is provided. The invention also provides a method of enhancing thrombin formation, a method for increasing blood clot formation in a subject, and a method for treating a disease or disorder, such as a blood coagulation disorder. The methods are, in their entirety, also referred to herein as, e.g., "the method of the invention." The methods comprise administering to a subject a peptide described herein in an amount effective to achieve a desired effect, e.g., an amount effective to inhibit Protein S activity, enhance thrombin formation, enhance blood clot formation, or treat the blood coagulation disorder in the subject. Further aspects of the invention include use of the peptide of the invention in medicine or for the manufacture of a medicament.

DESCRIPTION OF THE FIGURES

FIG. 1A-C is a chart providing the binding affinity (Mean IC50 [nM]) of various peptides described herein measured by LANCE IC50 assay using JBS0684 as a tracer peptide.

FIG. 2A-JJ is a chart providing the amino acid sequences of various peptides described herein.

DETAILED DESCRIPTION OF THE INVENTION

The invention provides peptides that bind Protein S and, in some instances, block the inhibitory (i.e., anticoagulant) activity of Protein S within the blood coagulation cascade. Protein S functions as a co-factor to activated Protein C (APC) to degrade Factors Va (FVa) and VIIIa (FVIIIa). Inhibition of Protein S reduces Protein C-mediated FVa and FVIIIa degradation, allowing the blood factors to function in the blood coagulation cascade to produce thrombin, and ultimately fibrin. Protein S is a 70 kD vitamin K-dependent glycoprotein, 635 amino acids in length, comprising a γ-carboxy-glutamic acid domain (Gla domain), a thrombin-sensitive module, epidermal growth factor like domains (EGF domains), and a region having similarity to the sex hormone binding globulin. The protein is found free in plasma and also complexed to complement protein C4b-binding protein (C4BP). Free Protein S serves as APC co-factor; the complexed form does not have co-factor activity. Protein S increases the affinity of APC for phospholipid-containing membranes, enhances APC-mediated cleavage at R306 in FVa, and enhances APC-mediated inactivation of FVIIIa. Walker, *J. Biol. Chem.,* 256(21), 11128-11131 (1981); Rosing et al., *J. Biol. Chem.,* 270(46), 27852-27858 (1995). Protein S also interferes with coagulation independent of APC by, for example, binding to FXa and FVa. Hackeng, *J. Biol. Chem.,* 269(33), 21051-21058 (1994). The sequence of human Protein S is provided as SEQ ID NO: 2917 (nucleic acid sequence provided as SEQ ID NO: 2918). The invention provides, in one aspect, Protein S-binding peptides that optionally block one or more of Protein S's activities, thereby optionally enhancing thrombin formation. In the context of the disclosure, any peptide encompassed by Formula I described herein and any Protein S-binding peptide described herein is also referred to as "the peptide of the invention" and as "a peptide as described herein." "Peptide" is meant to include traditional peptides (i.e., having a traditional peptide backbone) as well as peptidomimetics (i.e., protein-like polymers having modified backbones and, optionally, side-chains found in amino acids).

The amino acid sequences of several peptides are provided herein. Conventional amino acids are identified according to their standard, one-letter or three-letter codes. Examples of non-conventional amino acids and additional peptide building blocks with their, e.g., three- or four-letter/number code (with the exception of Ttds and Dopa, which are common four-letter abbreviations) are described in Table 1 and elsewhere herein. The chemical structures of the non-conventional amino acids and building blocks are known in the art and described in, e.g., U.S. Patent Application Publication No. 2013/0252896, incorporated by reference herein in its entirety, including Tables 1-3.

The amino acid sequences of the peptides provided herein are depicted in typical peptide sequence format. For example, the three-letter code or one-letter code of an amino acid indicates the presence of the amino acid in a specified position within the peptide sequence. The code for each non-conventional amino acid or building block is connected to the code for the next and/or previous amino acid or building block in the sequence by a hyphen in many instances. Adjacent amino acids are connected by a chemical bond (typically an amide bond). The formation of the chemical bond removes a hydroxyl group from the 1-carboxyl group of the amino acid when it is located to the left of the adjacent amino acid (e.g., Hle-adjacent amino acid), and removes a hydrogen from the amino group of the amino acid when it is located on the right of the adjacent amino acid (e.g., adjacent amino acid-Hle). It is understood that both modifications can apply to the same amino acid and apply to adjacent conventional amino acids present in amino acid sequences without hyphens explicitly illustrated. Where an amino acid contains more than one amino and/or carboxy group in the amino acid side chain, the 2- or 3-amino group and/or the 1-carboxy group generally are used for the formation of peptide bonds. For some non-conventional amino acids, a three-letter code is used where the first letter indicates the stereochemistry of the C-α-atom. For example, a capital first letter indicates that the L-form of the amino acid is present in the peptide sequence, while a lower case first letter indicating that the D-form of the corresponding amino acid is present in the peptide sequence. When one-letter code is used, a lower case letter represents a D-amino acid, while an upper case letter represents an L-amino acid. Unless indicated to the contrary, the amino acid sequences are presented herein in N- to C-terminus direction.

The C-termini of several peptide sequences described herein are often explicitly illustrated by inclusion of an OH, $NH_2$, or an abbreviation for a specific terminating amine linked to the C-terminal amino acid code via a hyphen. The N-termini of several peptides described herein are explicitly illustrated by inclusion of a hydrogen (for a free N-terminus), or an abbreviation for a specific terminating carboxylic acid or other chemical group linked to the N-terminal amino acid code via a hyphen.

The invention provides a peptide comprising the structure of Formula (I): X1004-X1005-X1006-X1007-X1008-X1009-X1010-X1011-X1012-X1013-X1014-X1015-X1016-X1017-X1018-X1019, wherein X1004 is A, C, D, E, F, G, H, I, K, L, M, N, P, p, Q, R, S, T, Tle, V, v, W, or Y; wherein X1005 is A, C, D, Dap, E, F, G, H, I, K, L, M, N, P, p, Q, R, S, s, T, V, W, or Y; wherein X1006 is A, a, Aib, C, D, E, F, G, H, I, K, L, M, N, P, p, Q, R, S, s, T, Tle, V, W, or Y; wherein X1007 is A, a, Aib, C, D, E, F, G, H, I, K, L, M, N, Nmg, P, p, Q, R, S, s, T, Tle, V, W, or Y; wherein X1008 is 1Ni, 2Ni, A, Bta, C, D, E, F, G, H, I, K, L, M, N, P, p, Q, R, S, T, V, W, w, or Y; wherein X1009 is A, C, D, E, F, G, H, I, K, L, M, N, P, p, Q, R, S, T, V, W, Y, or w; wherein X1010 is A, C, D, d, E, F, G, H, I, K, L, M, N, P, p, Q, R, S, T, V, W, w, or Y; wherein X1011 is A, C, D, E, F, G, H, I, K, L, M, N, P, p, Q, R, S, T, V, W, Y, or w; wherein X1012 is A, C, D, E, F, G, H, I, K, L, M, N, n, P, p, Q, R, S, T, V, W, or Y; wherein X1013 is A, a, C, D, E, F, G, H, I, K, L, M, N, P, p, Q, R, S, T, t, V, W, or Y; wherein X1014 is A, C, D, d, E, F, G, H, I, K, L, M, N, P, p, Q, R, S, T, V, W, or Y; wherein X1015 is A, C, D, E, F, G, H, I, K, L, M, N, P, p, Q, R, S, T, t, Tle, V, W, or Y; wherein X1016 is A, C, D, E, F, G, H, I, K, L, M, N, P, p, Q, R, S, T, V, W, or Y; wherein X1017 is A, C, D, E, F, G, H, I, K, L, M, N, Nle, P, p, Q, R, S, T, V, W, Y, or y; wherein X1018 is A, C, D, E, e, F, G, H, I, K, L, M, N, P, p, Q, R, S, T, V, W, or Y; and wherein X1019 is A, C, D, E, F, f, G, H, I, K, L, M, N, P, p, Q, R, S, T, V, W, or Y (SEQ ID NO: 2921).

In various embodiments, the invention provides a peptide comprising (or consisting of) an amino acid sequence at least 50% identical (e.g., at least 55% identical, at least 60% identical, at least 65% identical, at least 70% identical, at least 75% identical, at least 80% identical, at least 85% identical, or at least 90% identical) to the amino acid sequence VSAGWYDYNTDTYYEF (SEQ ID NO: 2920)

and having the structure of Formula I, wherein X1004 is A, C, D, E, F, G, H, I, K, L, M, N, P, p, Q, R, S, T, Tle, V, v, W, or Y; wherein X1005 is A, C, D, Dap, E, F, G, H, I, K, L, M, N, P, p, Q, R, S, s, T, V, W, or Y; wherein X1006 is A, a, Aib, C, D, E, F, G, H, I, K, L, M, N, P, p, Q, R, S, s, T, Tle, V, W, or Y; wherein X1007 is A, a, Aib, C, D, E, F, G, H, I, K, L, M, N, Nmg, P, p, Q, R, S, s, T, Tle, V, W, or Y; wherein X1008 is 1Ni, 2Ni, A, Bta, C, D, E, F, G, H, I, K, L, M, N, P, p, Q, R, S, T, V, W, w, or Y; wherein X1009 is A, C, D, E, F, G, H, I, K, L, M, N, P, p, Q, R, S, T, V, W, Y, or w; wherein X1010 is A, C, D, d, E, F, G, H, I, K, L, M, N, P, p, Q, R, S, T, V, W, w, or Y; wherein X1011 is A, C, D, E, F, G, H, I, K, L, M, N, P, p, Q, R, S, T, V, W, Y, or w; wherein X1012 is A, C, D, E, F, G, H, I, K, L, M, N, n, P, p, Q, R, S, T, V, W, or Y; wherein X1013 is A, a, C, D, E, F, G, H, I, K, L, M, N, P, p, Q, R, S, T, t, V, W, or Y; wherein X1014 is A, C, D, d, E, F, G, H, I, K, L, M, N, P, p, Q, R, S, T, V, W, or Y; wherein X1015 is A, C, D, E, F, G, H, I, K, L, M, N, P, p, Q, R, S, T, t, Tle, V, W, or Y; wherein X1016 is A, C, D, E, F, G, H, I, K, L, M, N, P, p, Q, R, S, T, V, W, or Y; wherein X1017 is A, C, D, E, F, G, H, I, K, L, M, N, Nle, P, p, Q, R, S, T, V, W, Y, or y; wherein X1018 is A, C, D, E, e, F, G, H, I, K, L, M, N, P, p, Q, R, S, T, V, W, or Y; and wherein X1019 is A, C, D, E, F, f, G, H, I, K, L, M, N, P, p, Q, R, S, T, V, W, or Y (SEQ ID NO: 2921).

In various embodiments of the invention, X1004 is A, E, F, G, H, I, K, L, M, N, P, Q, R, T, V, W, or Y; X1005 is A, D, E, F, G, H, I, K, L, M, N, R, S, T, V, W, or Y; X1006 is A, a, F, G, H, I, L, M, P, S, T, V, W, or Y; X1007 is G or a; X1008 is F, H, L, W, or Y; X1009 is F or Y; X1010 is A, D, E, F, G, H, I, K, L, M, N, Q, R, S, T, V, W, or Y; X1011 is A, E, F, G, H, I, K, L, M, N, P, Q, R, S, T, V, W, or Y; X1012 is A, D, E, F, G, H, I, K, L, M, N, n, P, Q, R, S, T, V, W, or Y; X1013 is A, D, E, F, G, H, I, K, L, M, N, Q, R, S, T, V, W, or Y; X1014 is A, D, d, E, G, H, N, Q, or S; X1015 is A, D, E, F, G, H, I, K, L, M, N, Q, R, S, T, V, W, or Y; X1016 is A, D, E, F, H, I, L, M, N, S, T, W, or Y; X1017 is A, D, E, F, G, H, I, K, L, M, N, Q, R, S, T, V, W, or Y; X1018 is A, D, E, F, G, H, I, K, L, M, N, P, Q, R, S, T, V, W, or Y; and X1019 is E, F, f, H, I, L, M, V, W, or Y.

In one aspect, the peptide of the invention comprises the structure of Formula (I) wherein X1004 is A, F, H, I, K, L, T, V, W, or Y (e.g., X1004 is selected from the group consisting of A, F, I, L, T, V, and W); X1005 is A, E, F, G, H, I, K, L, M, N, Q, R, S, T, V, W, or Y (e.g., X1005 is selected from the group consisting of A, E, F, G, H, I, K, L, M, R, S, T, V, W, and Y); X1006 is A, F, G, I, L, M, V, W, or Y (e.g., X1006 is selected from the group consisting of A, F, G, I, L, V, W, and Y); X1007 is G; X1008 is F, L, W, or Y (e.g., F or Y); X1010 is A, D, E, F, H, I, K, L, M, N, Q, R, S, T, V, W, or Y (e.g., X1010 is selected from the group consisting of D, E, F, H, I, K, L, N, Q, V, W, and Y); X1011 is A, F, G, H, I, K, L, M, N, R, S, T, V, W, or Y (e.g., X1011 is selected from the group consisting of F, G, I, K, L, M, R, T, V, W, and Y); X1012 is A, D, E, F, G, H, I, K, L, M, N, n, P, Q, R, S, T, V, W, or Y (e.g., X1012 is selected from the group consisting of D, E, F, G, H, I, K, L, N, Q, R, S, T, V, and Y); X1013 is D, E, F, G, H, I, K, L, Q, R, S, T, V, or W; X1014 is D, d, E, G, H, or N (e.g., X1014 is selected from the group consisting of D, E, and H); X1015 is D, E, H, I, K, M, Q, R, S, T, V, or W; X1016 is D, E, F, H, S, W, or Y (e.g., X1016 is selected from the group consisting of F, H, W, and Y); X1017 is D, E, G, H, I, T, W, or Y; X1018 is A, D, E, G, H, I, K, L, M, P, Q, R, S, T, V, or W; and X1019 is F, I, M, W, or Y (e.g., X1019 is selected from the group consisting of F, I, M, and W). In one or more aspects, X1004 is V, X1005 is S, X1006 is A, X1007 is G, X1008 is W, and X1009 is Y. The peptide optionally comprises an amino acid sequence at least 50% identical to VSAGWYDYNTD-TYYEF (SEQ ID NO: 2920).

In some embodiments, the peptide of the invention comprises one or more additional amino acid residues attached to the N- or C-terminus of the amino acid sequence. For example, the peptide comprising the structure of Formula I, in some embodiments, further comprises one or more N-terminal amino acid(s) directly linked to X1004, wherein the N-terminal amino acid(s) comprise the amino acid sequence selected from the group consisting of X1003, X1002-X1003, and X1001-X1002-X1003. X1003 and X1002 are independently selected from A, C, D, E, F, G, H, I, K, L, M, N, P, p, Q, R, S, T, Tle, V, W, Y, or y (e.g., X1003 and X1002 are independently selected from A, D, E, F, G, H, I, K, L, M, N, P, p, Q, R, S, T, V, W, y, or Y). For example, in some aspects, X1003 is A, E, F, G, H, I, K, L, N, P, R, T, V, W, y, or Y; and X1002 is A, D, E, F, G, H, I, K, L, N, P, R, T, V, W, y, or Y. X1001 is A, Bpa, C, D, E, e, F, G, H, I, K, L, M, N, P, p, Q, R, S, T, V, W, or Y (e.g., X1001 is selected from the group consisting of A, D, E, e, F, G, H, I, K, L, M, N, P, p, Q, R, S, T, V, W, and Y).

In addition to the core structure set forth in Formula I, other structures that are specifically contemplated are those in which one or more additional amino acids are attached to the C-terminus of the core structure directly linked to X1019. For example, the C-terminal addition optionally comprises an amino acid sequence selected from the group consisting of A, C, D, E, e, F, G, H, I, K, L, M, N, P, p, Q, R, S, T, V, W, and Y, such as the group consisting of A, D, E, e, F, G, H, I, K, L, M, N, P, p, Q, R, S, T, V, W, and Y. The invention further provides a peptide comprising at least 50% identity to the amino acid sequence EYYVSAGWY-DYNTDTYYEFE (SEQ ID NO: 2924) and comprising the formula X1001-X1002-X1003-X1004-X1005-X1006-X1007-X1008-X1009-X1010-X1011-X1012-X1013-X1014-X1015-X1016-X1017-X1018-X1019-X1020, as each amino acid position is defined above (SEQ ID NO: 2923).

The invention includes a peptide comprising or consisting of an amino acid sequence having at least 60% identity, at least 65%, at least 70%, at least 75%, at least 80%, at least 85%, at least 90%, at least 95% or 100% identity to (i) the amino acid sequence VSAGWYDYNTDTYYEF (SEQ ID NO: 2920), (ii) the amino acid sequence EYYVSAGWY-DYNTDTYYEFE (SEQ ID NO: 2924), or (iii) the amino acid sequence of any one of SEQ ID NO: 1-2916. As used herein, "at least 60% identity" and similar terms encompass any integer from, e.g., 60% to 100%, such as 60%, 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99% and the like. Also, the term "at least [percentage] identity" encompasses any percentage that is greater than or equal to the number of identical amino acids (or peptide building blocks) divided by the total number of amino acids (or building blocks) of the peptide of the invention ([at least percentage identity]≥[number of identical amino acids or building blocks]/[total number of amino acids or building blocks of the peptide of the invention]). The calculation of percent identity of aligned amino acids (or nucleotides) of two or more sequences is well understood in the art and is determined conventionally using known computer programs. For example, alignment of two or more sequences to determine percent sequence identity is optionally performed using the algorithm described by Altschul et al. (Nucleic Acids Res., 25:3389-402 (1997)) as incorporated into BLAST (basic local alignment search tool) programs, available on the National Center for Biotechnology Information website. The peptide preferably binds Protein S and, optionally, inhibits Protein S activity.

The invention includes peptides that comprise a cyclic structure. In this regard, the invention includes peptides comprising cyclic structures within the peptide (e.g., one or more loops formed by linkage between amino acids), peptides comprising a cyclic structure formed by the interaction of a terminal amino acid with an amino acid within the peptide sequence, and peptides cyclized head to tail. The peptides of the invention, in some instances, comprise intramolecular disulfide bonds. In some embodiments, the intramolecular disulfide bonds are formed by cysteine residues. Peptides comprising cyclic structures formed by non-cysteine residues, or a non-cysteine residue and a cysteine residue, also are provided. Suitable non-conventional amino acids or chemical moieties for cyclization include, but are not limited to, 3-[2-(2-{2-[2-(2-Amino-ethoxy)-ethoxy]-ethoxy}-ethoxy)-ethoxy]-propionic acid (FA19205), 3-(2-{2-[2-(2-Amino-ethoxy)-ethoxy]-ethoxy}-ethoxy)-propionic acid (FA19204), 3-{2-[2-(2-Amino-ethoxy)-ethoxy]-ethoxy}-propionic acid (FA19203), [2-(2-Amino-ethoxy)-ethoxy]-acetic acid (FA03202), (S)-Homo-cysteine (Hcy), D-Homo-cysteine (hcy), Aminoethylthiol (Cea), and c.

The peptides described herein are, in some embodiments, conjugated or attached to one or more moieties at the N- and/or C-terminus or at residues internal to the peptide. Exemplary moieties include, but are not limited to, carboxyfluorescein-Ttds (FAM-Ttds), a proline-glutamate tag ("PE"), Palmitoyl (Palm), 2-phenyl acetyl, 3-phenyl propionyl, 2-(naphth-2-yl)acetyl, hexanoyl, 2-methyl propionyl, 3-methyl butanoyl, 2-naphthylsulfonyl, acetyl, Aminooxy-acetic acid (AOA), levulinic acid (Lev), pentynoic acid (Pyn), 1-naphthylsulfonyl, C, c, N-ethylmaleiimido Ethylmaleiimido cysteine (C(NEM)), 3-[2-(2-{2-[2-(2-Amino-ethoxy)-ethoxy]-ethoxy}-ethoxy)-ethoxy]-propionic acid (FA19205), 3-(2-{2-[2-(2-Amino-ethoxy)-ethoxy]-ethoxy}-ethoxy)-propionic acid (FA19204), 3-{2-[2-(2-Amino-ethoxy)-ethoxy]-ethoxy}-propionic acid (FA19203), [2-(2-Amino-ethoxy)-ethoxy]-acetic acid (FA03202), K(Tdts-maleimid), 2-Amino-6-ε-(2-aminooxyAminooxy-acetylamino)-hexanoic acidL-lysine (K(AOA)), Aminoethylthiol (Cea), Eag, (S)-Homo-lysine (Hly), K, (S)-Ornithine (Orn), (S)-2,4-Diaminobutyric acid (Dab), (S)-Diaminopropionic acid (Dap), (S)-Diaminopropionic acid (Hcy), penicillamine (Pen), ε-(Myristyl)-L-lysine (K(Myr)), ε-(Myristyl-Ttds)-L-lysine (K(Ttds-Myr)), ε-(Palmityl-Ttds)-L-lysine (K(Ttds-Palm)), ε-(Myristyl-γ-glutamyl-Ttds)-L-lysine (K(Ttds-γGlu-Myr)), ε-(4-(p-Iodophenyl)butyryl))-L-lysine (K(AlbuTag)), ε-(4-(Pentyl)-benzolsulfonamidyl)-L-lysine (K(4PBSA)), (S)-4-Benzoylphenylalanine (Bpa), Bpa-K(Bio)-C, C(Atf-Bio), C(Atf-LC-Bio), C(FeBABE), C(MalCy5), C(PEG), ε-(Acetyl)-L-lysine (K(Ac)), K(Ttds), K(Ttds-γGlu), K(Glutar), K(Ttds-Mal), T, Ttds, or Ttds-K(Bio). K(Bio) is ε-(Biotinyl)-L-lysine. C(Atf-Bio) is 2-Amino-3-[2-(2-(4-azido-2,3,5,6-tetrafluoro-benzoylamino)-6-{6-[5-(2-oxo-hexahydro-thieno[3,4-d]imidazol-6-yl)-pentanoylamino]-hexanoylamino}-ethyldisulfanyl]-propionic acid. C(Atf-LC-Bio) is 2-Amino-3-[2-(2-[6-(4-azido-2,3,5,6-tetrafluoro-benzoylamino)-hexanoylamino]-6-{6-[5-(2-oxo-hexahydro-thieno[3,4-d]imidazol-6-yl)-pentanoylamino]-hexanoylamino)-ethyldisulfanyl]-propionic acid. C(FeBABE) is an Fe(III)-complex of 2-Amino-3-({4-[2,3-bis-(bis-carboxymethyl-amino)-propyl]-phenylcarbamoyl}-methylsulfanyl)-propionic acid. This is an ethylenediamine tetra acetic acid (EDTA)-complex of Fe(III) linked to the sulfur of the cysteine side chain via a thioether bond and an aromatic spacer. C(MalCy5) is 2-{5-[1-(5-{2-[3-(2-Amino-2-carboxy-ethylsulfanyl)-2,5-dioxo-pyrrolidin-1-yl]-ethylcarbamoyl}-pentyl)-3,3-dimethyl-1,3-dihydro-indol-2-ylidene]-penta-1,3-dienyl}-1,3,3-trimethyl-3H-indolium.

This is the dye Cy5 conjugated to the sulfur of the cysteine via a maleimide based thioether linkage.

In one aspect, the amino acid sequence of a peptide comprises a conservative substitution, wherein an amino acid residue is replaced with an amino acid residue having a similar side chain. Families of amino acid residues having similar side chains have been defined within the art, and include amino acids with basic side chains (e.g., lysine, arginine, and histidine), acidic side chains (e.g., aspartic acid and glutamic acid), uncharged polar side chains (e.g., glycine, asparagine, glutamine, serine, threonine, tyrosine, and cysteine), nonpolar side chains (e.g., alanine, valine, leucine, isoleucine, proline, phenylalanine, methionine, and tryptophan), beta-branched side chains (e.g., threonine, valine, and isoleucine), and aromatic side chains (e.g., tyrosine, phenylalanine, tryptophan, and histidine). It will be appreciated, however, that a practitioner is not limited to conservative substitutions; preferably, the resulting peptide retains the ability to bind Protein S and, optionally, downregulates, in whole or in part, Protein S activity. For instance, FIG. 1 describes peptides that are substitutional mutants of the amino acid sequence of JBS2512 (SEQ ID NO: 2) and which retain Protein S binding characteristics.

In one aspect, the peptide of the invention consists of 60 amino acids or less, 55 amino acids or less, 40 amino acids or less, 35 amino acids or less, or 30 amino acids or less. Optionally, the peptide consists of 25 amino acids or less, 20 amino acids or less, 15 amino acids or less, or 10 amino acids or less. In various embodiments, the peptide comprises 15-35 amino acid residues (e.g., 15, 16, 17, 18, 19, 20, 21, 22, 23, 24, 25, 26, 27, 28, 29, 30, 31, 32, 33, 34, or 35 amino acid residues). In some aspects, amino acids are removed from the peptide described herein from within the amino acid sequence, at the N-terminus, and/or at the C-terminus. Such peptide fragments can comprise 3-14 amino acid residues (e.g., 3, 4, 5, 6, 7, 8, 9, 10, 11, 12, 13, or 14 amino acid residues). The peptide of the invention is, in various embodiments, fused or complexed to a second peptide domain that, for example, binds another target (such as a different region of Protein S or a different protein) or increases the half-life or stability of the inventive peptide. In such fusions or complexes, the size of the peptide of the invention is exclusive of the second peptide or heterologous peptide domain.

In one aspect, the peptide further comprises one or more amino acids that facilitate synthesis, handling, or use of the peptide, including, but not limited to, one or two lysines at the N-terminus and/or C-terminus to increase solubility of the peptide. Suitable fusion proteins include, but are not limited to, proteins comprising a peptide of the invention (e.g., Protein S-binding peptide) linked to one or more polypeptides, polypeptide fragments, or amino acids not generally recognized to be part of the protein sequence. In one aspect, a fusion peptide comprises the entire amino acid sequences of two or more peptides or, alternatively, comprises portions (fragments) of two or more peptides. In some aspects, a peptide (e.g., Protein S-binding peptide) is operably linked to, for instance, one or more of the following: a marker protein, a peptide that facilitates purification, a peptide sequence that promotes formation of multimeric proteins, or a fragment of any of the foregoing. Suitable fusion partners include, but are not limited to, a His tag, a FLAG tag, a strep tag, and a myc tag.

Optionally, the peptide of the invention is fused to one or more entities that enhance the half life of the peptide. Half life can be increased by, e.g., increasing the molecular weight of the Protein S-binding peptide to avoid renal clearance and/or incorporating a ligand for the nFc receptor-mediated recycling pathway. In one embodiment, the peptide of the invention is fused to or chemically conjugated to an albumin polypeptide or a fragment thereof (e.g., human serum albumin (HSA) or bovine serum albumin (BSA)). The albumin fragment comprises 10%, 25%, 50%, or 75% of the full length albumin protein. An exemplary peptide-albumin conjugate is JBS3754 (SEQ ID NO: 999), which is JBS3216 (SEQ ID NO: 462) conjugated to albumin. JBS3761 also is an example of an albumin fusion (SEQ ID NO: 1005). Alternatively or in addition, the peptide of the invention is fused to or complexed with an albumin binding domain or fatty acid that binds albumin when administered in vivo. An example of an albumin binding domain is "albu-tag," a moiety derived from on 4-(p-iodophenyl)-butanoic acid (Dumelin et al., *Angew Chem Int Ed Engl* 47:3196-3201 (2008)). Other suitable fusion partners include, but are not limited to, a proline-alanine-serine multimer (PASylation) and an antibody or fragment thereof (e.g., an Fc portion of an antibody).

In one embodiment, two or more peptides of the invention are fused together, linked by a multimerization domain, or attached via chemical linkage to generate a peptide complex. The peptides of the multimer may be the same or different. Thus, the invention provides a homo-dimer (i.e., a dimer comprising two identical peptides), a homo-multimer (i.e., a complex comprising three or more identical peptides), a hetero-dimer (i.e., a dimer comprising two different peptides), and hetero-multimer (i.e., a complex comprising three or more peptides, wherein at least two of the peptides are different) comprising or consisting of any of the peptides described herein, optionally attached by one or more linkers. A representative multimer is JBS3179 (SEQ ID NO: 433), a tetramer of JBS2572 (SEQ ID NO: 62) monomers coupled via a 40 kD, four-arm PEG moiety.

In this regard, the invention provides a peptide complex comprising a first peptide and a second peptide. Any of the peptides described herein are suitable subunits (e.g., first peptide or second peptide) for the peptide complex. In some embodiments, the peptide complex comprises 25-100 amino acids, e.g., 30-80 amino acids, 30-60 amino acids, or 30-50 amino acids. The level of inhibition of at least one Protein S activity (e.g., Protein S binding to FVa, phospholipid binding, or APC cofactor activity) mediated by the peptide complex is optionally greater than the level of inhibition achieved by the first peptide or the second peptide (alone or, optionally, in combination) in various embodiments of the invention. The functional characteristics and therapeutic and diagnostic applications of monomeric Protein S-binding peptides described herein also are applicable to the peptide complexes described herein. Similarly, descriptions of modifications to monomeric Protein S-binding peptides also relate to peptide complexes.

In various aspects of the disclosure, the peptide subunits (e.g., first peptide and second peptide) of the peptide complex are fused together directly or are linked by a linker moiety. Any linker moiety is suitable for use in the context of the peptide complex. The linker moiety, in some aspects of the invention, bridges a distance of about 1 Å to about 100 Å, e.g., about 5 Å to about 80 Å (about 5 Å to about 50 Å), about 10 Å to about 70 Å (about 10 Å to about 60 Å, about 10 Å to about 50 Å, about 10 Å to about 40 Å, or about 10 Å to about 30 Å), in one of its conformations. Thus, the linker is optionally about 1 Å to about 100 Å in length, e.g., about 5 Å to about 50 Å or about 10 Å to about 30 Å in length in one of its conformations. Linkers of greater length (greater than about 100 Å) also are contemplated. For example, biocompatible polymers, optionally having a molecular weight of about 2 kDa to about 60 kDa, also are contemplated for use in the peptide complex. Examples of biocompatible polymers include, but are not limited to, PEG, PSA, proline-alanine-serine multimer, and hydroxyethyl starch. Additional description of linker moieties and reactive groups is provided in International Patent Publication No. WO 2011/143209, incorporated herein by reference in its entirety.

In one aspect, the linker moiety comprises the structure $Z_{1-20}$, wherein Z is an oligomer building block. Examples of oligomer building blocks include, but are not limited to, an amino acid, hydroxy acid, ethylene glycol, propylene glycol, or a combination of any of the foregoing. For example, the linker moiety is optionally an amino acid, a dipeptide, a tripeptide, or a polypeptide comprising 4-20 amino acids. In some embodiments, Z is G, s, S, a, A, Bal, Gaba, Ahx, Ttds, or a combination of any of the foregoing (such as peptide ten-mer comprising A, S, or a combination of A and S). If desired, the linking moiety comprises an amine, ether, thioether, maleimide, disulfide, amide, ester, alkene, cycloalkene, alkyne, trizoyl, carbamate, carbonate, or hydrazone.

The terms "first peptide" and "second peptide" are not meant to imply a particular physical order of the peptides, but merely to distinguish different subunits of the peptide complex. The subunits of the peptide complex may be linked in any of a number of configurations so long as the first peptide and second peptide interact with a target (e.g., Protein S). For example, the C-terminus of the first peptide is connected to the N-terminus of the second peptide, the N-terminus of the first peptide is connected to the C-terminus of the second peptide, the N- or C-terminus of the first (or second) peptide is connected to an internal attachment point in the second (or first) peptide, or the first and second peptides are connected via internal attachment points (i.e., attachment points located within the amino acid sequence of the peptide and not at the N- or C-terminus). More than one linker may be used, e.g., a first linking moiety is attached at the N-terminus of the first peptide and the C-terminus of the second peptide, and a second linking moiety (which may be the same type of moiety or a different type of moiety) is attached at the C-terminus of the first peptide and attached at the N-terminus of the second peptide. While the discussion of possible configurations refers to the first and second peptides, it will be appreciated that additional peptides may be linked to the first and/or second peptides as described herein.

Derivatives are included in the invention and include peptides that have been chemically modified in some manner distinct from addition, deletion, or substitution of amino acids. In this regard, a peptide provided herein is chemically bonded with polymers, lipids, other organic moieties, and/or inorganic moieties. Examples of peptide and protein modifications are given in Hermanson, *Bioconjugate Techniques*, Academic Press, (1996). The peptides described herein optionally comprise a functional group that facilitates conjugation to another moiety (e.g., a peptide moiety). Exemplary functional groups include, but are not limited to, isothiocyanate, isocyanate, acyl azide, NHS ester, sulfonyl chloride, aldehyde, epoxide, oxirane, carbonate, arylating agent, imidoester, carbodiimide, anhydride, alkyl halide derivatives (e.g., haloacetyl derivatives), maleimide, aziridine, acryloyl derivatives, arylating agents, thiol-disulfide exchange reagents (e.g., pyridyl disulfides or TNB thiol), diazoalkane, carboyldiimadazole, N,N'-Disuccinyl carbonate, N-Hydroxysuccinimidyl chloroformate, and hydrazine derivatives. Maleimide is useful, for example, for generating a Protein S-binding peptide that binds with albumin in vivo.

In one aspect, the invention includes peptides described herein covalently modified to include one or more water soluble polymer attachments. A water soluble polymer (or other chemical moiety) is attached to any amino acid residue, although attachment to the N- or C-terminus is preferred in some embodiments. Useful polymers include, but are not limited to, PEG (e.g., PEG approximately 40 kD, 30 kD, 20 kD, 10 kD, 5 kD, or 1 kD in size), polyoxyethylene glycol, polypropylene glycol, monomethoxy-polyethylene glycol, dextran, hydroxyethyl starch, cellulose, poly-(N-vinyl pyrrolidone)-polyethylene glycol, propylene glycol homopolymers, a polypropylene oxide/ethylene oxide co-polymer, polysialic acid (PSA), polyoxyethylated polyols (e.g., glycerol) and polyvinyl alcohol, as well as mixtures of any of the foregoing. In one aspect, the peptide of the invention is a PEGylated peptide. PEG moieties are available in different shapes, e.g., linear or branched. Exemplary PEGylated peptides include JBS3755 (SEQ ID NO: 1000), which comprises the amino acid sequence of JBS3216 (SEQ ID NO: 462) attached to 20 kD linear PEG moieties at the N-terminus via Ahx (6-aminohexanoic acid) and the C-terminal end via the ε amino group of Lys, and JBS3757 (SEQ ID NO: 1002), wherein the 20 kD PEG moieties are branched. For further discussion of water soluble polymer attachments, see U.S. Pat. Nos. 4,640,835; 4,496,689; 4,301,144; 4,670,417; 4,791,192; and 4,179,337. Other moieties useful for improving peptide half life or stability are described herein and include, for instance, albumin (optionally modified to allow conjugation to the inventive peptide), fatty acid chains (e.g., C12-C18 fatty acid, such as a C14 fatty acid, or dicarboxylic acids, such as octadecane dicarboxylic acid (oddc)), an antibody or fragment thereof (e.g., an Fc portion of an antibody), and proline-alanine-serine multimers.

In another aspect, a peptide derivative includes a targeting moiety specific for a particular cell type, tissue, and/or organ. Alternatively, the peptide is linked to one or more chemical moieties that facilitate purification, detection, multimerization, binding with an interaction partner, and characterization of peptide activity. An exemplary chemical moiety is biotin. Other moieties suitable for conjugation to the peptide of the invention include, but are not limited to, a photosensitizer, a dye, a fluorescence dye, a radionuclide, a radionuclide-containing complex, an enzyme, a toxin, and a cytotoxic agent. Photosensitizers include, e.g., Photofrin, Visudyne, Levulan, Foscan, Metvix, Hexvix®, Cysview™, Laserphyrin, Antrin, Photochlor, Photosens, Photrex, Lumacan, Cevira, Visonac, BF-200 ALA, and Amphinex. If desired, a His tag, a FLAG tag, a strep tag, or a myc tag is conjugated to the peptide.

In addition, in one aspect, the peptides of the invention are acylated at the N-terminal amino acid of the peptide. In another aspect, the peptides of the invention are amidated at the C-terminal amino acid of the peptide. In a still further aspect, the peptides of the invention are acylated at the N-terminal amino acid of the peptide and are amidated at the C-terminal amino acid of the peptide.

Derivatives also include peptides comprising modified or non-proteinogenic amino acids or a modified linker group (see, e.g., Grant, *Synthetic Peptides: A User's Guide*, Oxford University Press (1992)). Modified amino acids include, for example, amino acids wherein the amino and/or carboxyl group is replaced by another group. Non-limiting examples include modified amino acids incorporating thioamides, ureas, thioureas, acylhydrazides, esters, olefines, sulfonamides, phosphoric acid amides, ketones, alcohols, boronic acid amides, benzodiazepines and other aromatic or non-aromatic heterocycles (see Estiarte et al., *Burgers Medicinal Chemistry*, $6^{th}$ edition, Volume 1, Part 4, John Wiley & Sons, New York (2002)). Non-proteinogenic amino acids include, but are not limited, to β-alanine (Bal), norvaline (Nva), norleucine (Nle), 4-aminobutyric acid (γ-Abu), 2-aminoisobutyric acid (Aib), 6-aminohexanoic acid (ε-Ahx), ornithine (Orn), hydroxyproline (Hyp), taurine, sarcosine, citrulline (Cit), cysteic acid (Coh), cyclohexylalanine (Cha), methioninesulfoxide (Meo), methioninesulfone (Moo), homoserinemethylester (Hsm), propargylglycine (Eag), 5-fluorotryptophan (5Fw), 6-fluorotryptophan (6Fw), 3',4'-dimethoxyphenyl-alanine (Ear), 3',4'-difluorophenylalanine (Dff), 4'-fluorophenyl-alanine (Pff), 1-naphthyl-alanine (1Ni), 2-Naphthylalanine (2Ni), 1-methyltryptophan (1Mw), penicillamine (Pen), homoserine (Hse), t-butylglycine, t-butylalanine, phenylglycine (Phg), benzothienylalanine (Bta), L-homo-cysteine (Hcy), N-methyl-phenylalanine (Nmf), 2-thienylalanine (Thi), 3,3-diphenylalanine (Ebw), L-alpha-t-Butylglycine (Tle), Bpa, homophenylalanine (Hfe), and S-benzyl-L-cysteine (Ece). These and other non-proteinogenic amino acids may exist as D- or L-isomers. Examples of modified linkers include, but are not limited to, the flexible linker 4,7,10-trioxa-1,13-tridecanediamine (Ttds), glycine, 6-aminohexanoic acid, beta-alanine (Bal), pentynoic acid (Pyn), and combinations of Ttds, glycine, 6-aminohexanoic acid and Bal.

Homologs of the amino acids constituting the peptides of the invention may be as set forth in Table 1. In any embodiment, one or more amino acids of the peptide of the invention are substituted with an amino acid or building block set forth in Table 1.

TABLE 1

| Amino Acid | Exemplary homologs/substitutions |
|---|---|
| A | 2-Amino-isobutyric acid (Aib), β-Alanine (Bal), (S)-2-Propargylglycine (Eag), (S)-N-Methylalanine (Nma), 2-Aminobutyric acid (Abu), G, M, (S)-2-Aminopentanoic acid (Nva), (S)-Norleucine (Nle) |
| C | S, A, (S)-Homo-cysteine (Hcy), M, L, I, V, (R)-N-Methylcysteine (Nmc), β-Cysteine |
| D | E, Homoglutamic acid, γ-Hydroxy-glutamic acid, γ-Carboxy-glutamic acid, (S)-N-Methyl-Aspartic acid (Nmd), β-Aspartic acid, N, Q, Cysteic acid, β-Homoaspartic acid (Bhd) |

TABLE 1-continued

| Amino Acid | Exemplary homologs/substitutions |
|---|---|
| E | D, Glu, Homoglutamic acid, γ-Hydroxy-glutamic acid, γ-Carboxy-glutamic acid, α-Aminoadipic acid, (S)-N-Methyl-glutamic acid (Nme), β-glutamic acid, Q, N, Cysteic acid, β-Homoglutamatic acid (Bhe) |
| F | L-Homophenylalanine (Hfe), (S)-N-Methyl-phenylalanine (Nmf), β-Phenylalanine, L-Phenylglycin (Phg), β-Homophenylalanine (Bhf), Thienylalanine, Benzothienylalanine, Bromophenylalanine, Iodophenylalanione, Chlorophenylalanine, Methylphenylalanine, Nitrophenylalanine, Y, W, Naphtylalanine, 1,2,3,4-L-tetrahydroisoquinolinecarboxylic acid (Tic) |
| G | A, a, N-Methyl-glycine (Nmg) |
| H | (S)-N-Methyl-histidine (Nmh), 1-Methylhistidine, 3-Methylhistidine, Thienylalanine |
| I | L, V, (S)-2-Amino-5-methyl-hexanoic acid (Hle), (S)-2-Amino-pentanoic acid (Nva), Nle, β-Isoleucine, (S)-N-Methyl-leucine (Nml), M, N-Methyl-L-isoleucine (Nmi), β-Homoisoleucine (Bhi), (S)-Cyclohexylalanine (Cha), L-Cyclohexylglycine (Chg) |
| K | (S)-N-Methyl-lysine (Nmk), R, (S)-N-Methyl-arginine (Nmr), β-Lysine, (S)-2,4-Diaminobutyric acid (Dab), (S)-Diaminopropionic acid (Dap), β-(1-Piperazinyl)-alanine, 2,6-Diamino-4-hexynoic acid, δ-Hydroxy-lysine, (S)-Homo-arginine (Har), ω-Hydroxy-norarginine, ω-Amino-arginine, ω-Methyl-arginine, β-(2-Pyridyl)-alanine, β-(3-Pyridyl)-alanine, 3-Amino-tyrosine, 4-Amino-phenylalanine, (S)-Homo-citrulline (Hci), (S)-Citrullin (Cit), β-Homolysine (Bhk) |
| L | I, V, Hle, Nle, (S)-2-Amino-pentanoic acid (Nva), β-Isoleucine, (S)-N-Methyl-leucine (Nml), M, β-Homovaline(Bhv), β-Homoleucine (Bhl), (S)-Cyclohexylalanine (Cha) |
| M | I, V, Hle, Nva, R, (S)-Homo-arginine (Har), (S)-N-Methyl-methionine (Nmm), Methioninesulfone, Methionine-sulphoxid (Met(O)), Nle |
| N | (S)-N-Methyl-asparagine (Nmn), β-Asparagine, Q, (S)-N-Methyl-glutamine (Nmq), β-Glutamine, Cys(3-propionic acid amide)-OH, Cys(O2-3-propionic acid amide)-OH, β-Homoasparagine (Bhn), β-Homoglutamine (Bhq) |
| P | Azetidine-2-carboxylic acid, 4-Hydroxy-L-proline (Hyp), α-Methyl-methionine, 4-Hydroxy-piperidine-2-carboxylic acid, D-Pipecolic acid (Pip), α-Methyl-Pro, 3-Amino-Pro, 4-Amino-Pro |
| Q | N, Nmn, (S)-N-Methyl-glutamine (Nmq), β-Glutamine, Cys(3-propionic acid amide)-OH, Cys(O2-3-propionic acid amide)-OH, Bhn, Bhq |
| R | (S)-N-Methyl-lysine (Nmk), K, (S)-N-Methyl-arginine (Nmr), β-Lysine, Dab, Dap, (S)-Ornithine (Orn), β-(1-Piperazinyl)-alanine, 2,6-Diamino-4-hexynoic acid, δ-Hydroxy-lysine, Har, ω-Hydroxy-norarginine, ω-Amino-arginine, ω-Methyl-arginine, β-(2-Pyridyl)-alanine, β-(3-Pyridyl)-alanine, 3-Amino-tyrosine, 4-Amino-phenylalanine, (S)-Homo-citrulline (Hci), (S)-Citrullin (Cit), Hle, L, (S)-Norleucine (Nle), M, Bhk, (S)-N-Methyl-lysine (Nmk) |
| S | T, homoserine (Hse), β-Serine, C, β-Cyano-alanine, allo-Threonine, β-Homoserine (Bhs) |
| T | S, Homothreonine, β-Threonine, allo-Threonine |
| V | L, I, Hle, (S)-2-Amino-pentanoic acid (Nva), Nle, β-Valine, (S)-N-Methyl-valine (Nmv), M, Nmi, (S)-N-Methyl-leucine (Nml), (S)-Cyclohexylalanine (Cha), L-Cyclohexylglycine (Chg) |
| W | (S)-N-Methyl-tryptophane (Nmw), β-Tryptophan, F, L-Homophenylalanine (Hfe), (S)-N-Methyl-phenylalanine (Nmf), β-Phenylalanine, L-Phenylglycin (Phg), β-Homophenylalanine (Bhf), Thienylalanine, Benzothienylalanine, Bromophenylalanine, Iodophenylalanine, Chlorophenylalanine, Methylphenylalanine, Nitrophenylalanine, Y, Naphtylalanine, 1,2,3,4-L-tetrahydroisoquinolinecarboxylic acid (Tic), β-Homotyrosine (Bhy) |
| Y | (S)-N-Methyl-tyrosine (Nmy), β-Tyrosine, F, Hfe, Nmf, β-Phenylalanine, Phg, Bhf, Thienylalanine, Benzothienylalanine, Bromophenylalanine, Iodophenylalanine, Chlorophenylalanine, Methylphenylalanine, Nitrophenylalanine, W, Naphtylalanine, Tic, Bhy |

In some embodiments, the peptide (CO—NH) linkages joining amino acids within the peptide of the invention are reversed to create a "retro-modified" peptide, i.e., a peptide comprising amino acid residues assembled in the opposite direction (NH—CO bonds) compared to the reference peptide. The retro-modified peptide comprises the same amino acid chirality as the reference peptide. An "inverso-modified" peptide is a peptide of the invention comprising amino acid residues assembled in the same direction as a reference peptide, but the chirality of the amino acids is inverted. Thus, where the reference peptide comprises L-amino acids, the "inverso-modified" peptide comprises D-amino acids, and vice versa. Inverso-modified peptides comprise CO—NH peptide bonds. A "retro-inverso modified" peptide refers to a peptide comprising amino acid residues assembled in the opposite direction and which have inverted chirality. A retro-inverso analogue has reversed termini and reversed direction of peptide bonds (i.e., NH—CO), while approximately maintaining the side chain topology found in the reference peptide. Retro-inverso peptidomimetics are made using standard methods, including the methods described in Meziere et al, *J. Immunol.*, 159, 3230-3237 (1997), incorporated herein by reference. Partial retro-inverso peptides are peptides in which only part of the amino acid sequence is reversed and replaced with enantiomeric amino acid residues.

Peptides of the invention are made in a variety of ways. In one aspect, the peptides are synthesized by solid phase synthesis techniques including those described in Merrifield, *J. Am. Chem. Soc.*, 85, 2149 (1963); Davis et al., *Biochem. Intl.*, 10, 394-414 (1985); Larsen et al., *J. Am. Chem. Soc.*, 115, 6247 (1993); Smith et al., *J. Peptide Protein Res.*, 44, 183 (1994); O'Donnell et al., *J. Am. Chem. Soc.*, 118, 6070 (1996); Stewart and Young, *Solid Phase Peptide Synthesis*, Freeman (1969); Finn et al., *The Proteins*, 3$^{rd}$ ed., vol. 2, pp. 105-253 (1976); and Erickson et al., *The Proteins*, 3$^{rd}$ ed., vol. 2, pp. 257-527 (1976). The invention contemplates synthetic peptides. Alternatively, the peptide is expressed recombinantly by introducing a nucleic acid encoding a peptide of the invention into host cells, which are cultured to express the peptide. Such peptides are purified from the culture media or cell pellets.

The invention also encompasses a nucleic acid comprising a nucleic acid sequence encoding a peptide of the invention. Methods of preparing DNA and/or RNA molecules are well known in the art. If desired, a peptide coding sequence is incorporated into an expression vector. One of ordinary skill in the art will appreciate that any of a number of expression vectors known in the art are suitable in the context of the invention, such as, but not limited to, plasmids, plasmid-liposome complexes, and viral vectors. Any of these expression vectors are prepared using standard recombinant DNA techniques described in, e.g., Sambrook et al., *Molecular Cloning, a Laboratory Manual*, 2d edition, Cold Spring Harbor Press, Cold Spring Harbor, N.Y. (1989), and Ausubel et al., *Current Protocols in Molecular Biology*, Greene Publishing Associates and John Wiley & Sons, New York, N.Y. (1994). Optionally, the nucleic acid is operably linked to one or more regulatory sequences, such as a promoter, activator, enhancer, cap signal, polyadenylation signal, or other signal involved with the control of transcription or translation.

Any of the peptides (or peptide complexes) of the invention or nucleic acids encoding the peptides also is provided in a composition (e.g., a pharmaceutical composition). In this regard, the peptide (or peptide complex) is formulated with a physiologically-acceptable (i.e., pharmacologically-acceptable) carrier, buffer, excipient, or diluent, as described further herein. Optionally, the peptide is in the form of a physiologically acceptable salt, which is encompassed by the invention. "Physiologically acceptable salts" means any salts that are pharmaceutically acceptable. Some examples of appropriate salts include acetate, hydrochloride, hydrobromide, sulfate, citrate, tartrate, glycolate, and oxalate. If desired, the composition comprises one or more additional pharmaceutically-effective agents.

The peptide provided herein preferably binds Protein S and optionally inhibits at least one Protein S activity such as, but not limited to, an activity that downregulates the blood coagulation cascade. Without being bound by any specific mechanism of action, the peptide may inhibit binding (competitively or allosterically) of Protein S to activated Protein C (APC), Factor V, or lipid surfaces, thereby limiting the naturally occurring inhibition of coagulation by Protein S. With Protein S activity diminished, FVa and FVIIIa are not as readily degraded and less FXa is inhibited, resulting in enhanced conversion of prothrombin to thrombin.

In one aspect, the peptide of the invention exhibits Protein S antagonistic activity in model and/or plasmatic systems. An exemplary plasma-based assay examines Protein S/APC-dependent thrombin generation initiated via the extrinsic coagulation pathway (Nicolaes, *Blood Coagul. Fibrinolysis*, 8:28 (1997)). Protein S enhances the anticoagulation effect of APC in plasma. Thrombin formation is triggered in plasma substantially lacking FVIII or FIX activity (e.g., the residual coagulation factor activity is lower than 1%) in the presence of a candidate peptide. Thrombin formation is detected using, e.g., a fluorogenic or chromogenic substrate. A system for measuring thrombin activity is provided by Thrombinoscope BV (Maastricht, The Netherlands). Prothrombin conversion is measured using, e.g., a Thrombograph™ (Thermo Scientific, Waltham, Mass.), and the resulting data is compiled into a Calibrated Automated Thrombogram (CAT) generated by Thrombinoscope™ software available from Thrombinoscope BV. In various embodiments, the peptide demonstrates an EC50 of about 20 nM to about 100 µM (e.g., about 40 nM to about 50 µM) in the Protein S/APC-dependent thrombin generation assay.

In certain embodiments, the Protein S-inhibitory peptide increases the amount of peak thrombin generated during the assay and/or decreases the time required to achieve peak thrombin formation. For example, the peptide improves Protein S-regulated thrombin generation in the absence of FVIII (e.g., in FVIII-depleted plasma) to at least 1% of the level of Protein S-dependent thrombin generation in normal plasma. Generally, normal (unafflicted) plasma contains about 0.5 U/mL to about 2 U/mL Factor VIII. Accordingly, in some instances, a Protein S-binding peptide (e.g., Protein S-inhibitory peptide) will enhance thrombin formation in the absence of FVIII to at least about 1% of that observed in the presence of 0.5 U/mL to 2 U/mL FVIII.

In various aspects, the peptide is administered to an animal model of thrombin deficiency or hemophilia to characterize Protein S inhibitory activity in vivo. Such in vivo models are known in the art and include for example, mice administered anti-FVIII antibodies to induce hemophilia A (Tranholm et al., *Blood*, 102, 3615-3620 (2003)); coagulation factor knock-out models such as, but not limited to, FVIII knock-out mice (Bi et al., *Nat. Genet.*, 10(1), 119-121 (1995)) and FIX knock-out mice (Wang et al., *PNAS*, 94(21), 11563-66 (1997)); induced hemophilia-A in rabbits (Shen et al., *Blood*, 42(4), 509-521 (1973)); and Chapel Hill HA dogs (Lozier et al., *PNAS*, 99, 12991-12996 (2002)).

Various peptides bind Protein S from any source including, but not limited to, mouse, rat, rabbit, dog, cat, cow, horse, pig, guinea pig, and primate. In one embodiment, the peptide binds human Protein S. Optionally, the peptide of the invention binds Protein S from more than one species (i.e., the peptide is cross-reactive among multiple species). In certain aspects, the peptide binds Protein S with a dissociation constant ($K_D$) of less than or equal to $1 \times 10^{-4}$ M, less than or equal to $1 \times 10^{-5}$ M, less than or equal to $1 \times 10^{-6}$ M, or less than or equal to $1 \times 10^{-7}$ M, or less than or equal to $1 \times 10^{-8}$ M, or less than or equal to $1 \times 10^{-9}$ M, or less than or equal to $1 \times 10^{-10}$ M.

Affinity may be determined using, for example and without limitation, any one, two, or more of a variety of techniques, such as an affinity ELISA (EC50) assay, a competitive ELISA (IC50) assay, a competitive LANCE IC50 assay (e.g., a homogenous europium-based TR-FRET assay described herein) and/or a surface plasmon resonance (BIAcore™) assay. Optionally, when using an ELISA-based affinity (EC50) assay (e.g., the assay described in Example 1), the peptide demonstrates an EC50 of $1 \times 10^{-4}$ M, less than or equal to $1 \times 10^{-5}$ M, less than or equal to $1 \times 10^{-6}$ M, less than or equal to $1 \times 10^{-7}$ M, less than or equal to $1 \times 10^{-8}$ M, or less than or equal to $1 \times 10^{-9}$ M. When characterized using a competitive (IC50) ELISA assay or LANCE IC50 assay, the peptide of the invention optionally demonstrates an IC50 of less than or equal to about 10,000 nM. For example, the peptide demonstrates an IC50 of less than or equal to about 5,000 nM, less than or equal to about 1,000 nM, or less than or equal to about 500 nM. In one aspect, the peptide demonstrates an IC50 of less than or equal to about 250 nM, less than or equal to about 100 nM, less than or equal to about 50 nM, or less than or equal to about 10 nM (e.g., less than or equal to about 9 nM, less than or equal to about 8 nM, less than or equal to about 7 nM, less than or equal to about 6 nM, less than or equal to about 5 nM, less than or equal to about 4 nM, less than or equal to about 3 nM, or less than or equal to about 1 nM). Optionally, competitive assays utilize JBS0684 (SEQ ID NO: 1) as the "tracer" (i.e., competing peptide). Thus, in various embodiments, the peptide binds human Protein S with an IC50 of less than 25 nM, less than 10 nM, less than 5 nM, less than 3 nM, or less than 1 nM in a competitive LANCE assay using a peptide comprising (or consisting of) the amino acid sequence of SEQ ID NO: 1 (JBS0684) as a tracer. Exemplary peptides and their IC50 values are provided in FIG. 1.

Another suitable assay for characterizing the inventive peptides is a $k_{off}$ assay, which examines a peptide's release from Protein S. The $k_{off}$ assay result is not the dissociation rate constant, but a percentage of competitor peptide blocked from Protein S binding by a test peptide after an incubation period with Protein S. An exemplary $k_{off}$ assay includes the following steps: 1) incubation of a Protein S-coated microtiter plate with an amount of test peptide resulting in approximately 90% Protein S occupation; 2) removal of unbound test peptide; 3) addition of a biotinylated tracer (i.e., competitor) peptide (e.g., JBS0684) that competes with the test peptide for binding to Protein S; 4) incubation for a period of time during which binding sites released by the test peptide is occupied by the tracer; 5) removal of unbound tracer and test peptide; and 6) detection of bound tracer by a chromogenic reaction using streptavidin-horseradish peroxidase conjugate. The resulting signal is indicative of binding sites freed by the test peptide. A test peptide that does not dissociate from Protein S during the incubation period yields a weaker signal compared to an analyte that dissociates completely. Optionally, the peptide demonstrates a $k_{off}$ of less than or equal to $1\times10^{-3}$ $s^{-1}$, less than or equal to $1\times10^{-4}$ $s^{-1}$, less than or equal to $1\times10^{-5}$ $s^{-1}$, less than or equal to $1\times10^{-6}$ $s^{-1}$, or less than or equal to $1\times10^{-7}$ $s^{-1}$.

As with all binding agents and binding assays, one of skill in the art recognizes that the various moieties to which a binding agent should not detectably bind in order to be biologically (e.g., therapeutically) effective would be exhaustive and impractical to list. Therefore, the term "specifically binds" refers to the ability of a peptide to bind Protein S with greater affinity than it binds to an unrelated control protein that is not Protein S. For example, the peptide may bind to Protein S with an affinity that is at least, 5, 10, 15, 25, 50, 100, 250, 500, 1000, or 10,000 times greater than the affinity for a control protein. In some embodiments, the peptide binds Protein S with greater affinity than it binds to an "anti-target," a protein or other naturally occurring substance in humans to which binding of the peptide might lead to adverse effects. Because Protein S-inhibitory peptides exert their activity in the blood stream and/or at the endothelium, plasma proteins represent potential anti-targets. Protein S also is a multi-domain protein harboring domains highly homologous to other proteins of the coagulation system proteins containing Gla-domains (e.g., GAS6, Factor VII, Factor IX, Factor X, Protein C, Protein Z, and prothrombin), EGF-like domains (e.g., GAS6, Factor VII, Factor IX, Factor X, Protein C, Protein Z, and thrombomodulin), and laminin G-like domains (e.g., GAS6). Proteins having these domains also are potential anti-targets. In various embodiments, human GAS6 is the anti-target due to its homology to Protein S (42% identity, 57% consensus sequence). Thus, in one aspect, the peptide of the invention binds to Protein S with an affinity that is at least 5, 10, 15, 25, 50, or 100 times greater than the affinity for an anti-target, such as human GAS6 (tested using any suitable method, such as a surface plasmon resonance assay (e.g., BIAcore)).

Optionally, the peptide of the invention demonstrates one or more desired characteristics described herein, and the amino acid sequence of a peptide can be modified to optimize binding, stability, and/or activity, if desired. An exemplary peptide binds Protein S with a $K_D$ of less than or equal to 10 μM and/or exhibits a binding affinity for Protein S that is at least 10 times greater than the binding affinity for an anti-target. Alternatively or in addition, the peptide enhances thrombin generation in Protein S deficient plasma supplemented with Protein S and APC or FVIII inhibited/deficient plasma with an EC50 (as measured using any suitable assay, such as the assays described here) of less than or equal to 10 μM and/or improves Protein S-dependent thrombin generation in the absence of Factor VIII activity to at least about 20% (e.g., 40%) of the level of thrombin formation in plasma containing normal Factor VIII activity. Alternatively or in addition, the peptide achieves a desired level of plasma stability (e.g., 50% or more of a dose remains in human plasma after six hours or 12 hours, or 50% or more of a dose remains in mouse plasma after four or eight hours) and/or demonstrates a desired half life in vivo (e.g., at least two, three, four, five, six, seven, eight, nine, or ten hours) and/or demonstrates a desired level of solubility. Alternatively or in addition, the peptide of the invention exhibits a desired level of bioavailability, such as a desired level of bioavailability following intravenous or subcutaneous administration (e.g., greater than or equal to 5%, 10%, 15%, 20%, 25%, 30%, or 50%) and/or demonstrates a desired level of Protein S-inhibitory activity at a given dose in vivo.

The invention further includes a method of inhibiting Protein S. The method comprises contacting Protein S with a peptide described herein. Optionally, the method comprises inhibiting Protein S in a subject, and the method comprises administering to the subject the peptide in an amount effective to inhibit Protein S activity. Any degree of Protein S activity inhibition is contemplated. For example, a peptide of the invention reduces Protein S inhibition of the coagulation cascade at least about 5% (e.g., at least about 10%, at least about 25%, or at least about 30%). In some embodiments, the peptide reduces Protein S activity at least about 50%, at least about 75%, or at least about 90% compared to Protein S activity in the absence of the peptide.

In one aspect of the invention, peptides of the invention are used to detect and/or quantify Protein S in vivo or in vitro. An exemplary method of detecting and/or quantifying Protein S in a sample comprises (a) contacting a sample with a peptide of the invention, and (b) detecting binding of the peptide to Protein S. The method is useful for therapy and diagnosis of disease where Protein S is a suitable diagnostic marker. Peptide-Protein S complexes are directly or indirectly detected. Detection moieties are widely used in the art to identify biological substances and include, for example, dye (e.g., fluorescent dye), radionuclides and radionuclide-containing complexes, and enzymes. Moieties allowing detection are optionally attached or conjugated to the peptide. In some aspects, peptide-Protein S binding is detected indirectly. In this regard, the peptide is optionally contacted with an interaction partner that binds the peptide of invention without significantly interfering with peptide-Protein S binding, and the interaction partner is detected. Exemplary interaction partners include, but are not limited to, antibodies, antigen-binding antibody fragments, anticalins and antibody mimetics, aptamers, streptavidin, avidin, neutravidin, and spiegelmers. Optionally, the interaction partner comprises a detection moiety to facilitate detection of an interaction partner-peptide complex. The peptide is, in some embodiments, modified to facilitate binding of an interaction partner. For example, in one aspect, the peptide of the invention is conjugated to biotin, which is bound by an interaction partner comprising streptavidin. An exemplary interaction partner comprises strepavidin fused to horseradish peroxidase, which is detected in, e.g., an ELISA-like assay. Alternatively, the peptide of the invention is modified to include an antibody epitope, and binding of the corresponding antibody to the peptide-Protein S complex is detected.

Peptide-Protein S complexes and interaction partner-peptide complexes are identified using any of a number of methods, such as, but not limited to, biochemical assays (e.g., enzymatic assays), spectroscopy (e.g., detection based on optical density, fluorescence, FRET, BRET, TR-FRET, fluorescence polarization, electrochemoluminescence, or NMR), positron emission tomography (PET), and single Photon Emission Computed Tomography (SPECT). Detectable moieties that facilitate fluorescence detection of peptide-Protein S complexes or interaction partner-peptide complexes include, but are not limited to, fluorescein, Alexa Fluor® 350, Marina Blue™, Cascade Yellow™, Alexa Fluor® 405, Pacific Blue™, Pacific Orange™, Alexa Fluor® 430, Alexa Fluor® 488, Oregon Green® 488, Alexa Fluor® 500, Oregon Green® 514, Alexa Fluor® 514, Alexa Fluor® 532, Alexa Fluor® 555, Tetramethylrhodamine, Alexa Fluor® 546, Rhodamine B, Rhodamine Red™-X, Alexa Fluor® 568, Alexa Fluor® 594, Texas Red®, Texas Red®-X, Alexa Fluor® 610, Alexa Fluor® 633, Alexa Fluor® 635, Alexa Fluor® 647, Alexa Fluor® 660, Alexa Fluor® 680, Alexa Fluor® 700, Alexa Fluor® 750, B-Phycoerythrin, R-Phycoerythrin, Allophycocyanin, BODIPY®, Cy3, Cy5, TAMRA, and fluorescent proteins (GFP and derivatives thereof).

The invention also provides a method for diagnosing a subject suffering from a disease or disorder, or at risk of suffering from a disease or disorder, wherein the disease or disorder is associated with or caused by aberrant Protein S activity. The method comprises administering to the subject the peptide of the invention and detecting Protein S-peptide complex. Detection of complexes is described above. The presence of the complex indicates the presence of Protein S, thereby allowing diagnosis of a disease or disorder associated with Protein S (e.g., a disease or disorder which (i) can be treated by inhibiting Protein S or (ii) comprises symptoms which can be ameliorated or prevented by inhibiting Protein S). If administration of the peptide to the subject is not desired, a biological sample is obtained from the subject, contacted with the peptide as described herein, and Protein S-peptide complexes are detected. It will be appreciated that methods of using the peptides described herein also include use of any of the peptide complexes described herein.

Some diseases and disorders, such as thrombophilia, venous thrombosis, and pulmonary embolism, are linked to reduced Protein S levels. Protein S deficiency can be hereditary or result from, e.g., vitamin K deficiency, warfarin treatment, pregnancy, infection, and liver disease. To detect a deficiency, the method optionally entails quantifying Protein S. If Protein S in the biological sample is below a desired threshold, treatment for the disease or disorder is commenced. In some instances, the treatment comprises anticoagulation therapy (such as heparin or warfarin therapies).

The peptides described herein preferably bind Protein S and, therefore, are useful for purifying Protein S (e.g., recombinant Protein S) from a biological sample (e.g., a biological fluid, such as serum), fermentation extract, tissue preparations, culture medium, and the like. The peptides also are useful for purifying proteins that interact with Protein S, such as, but not limited to, C4BP. The invention includes methods of using the peptide of the invention in the commercial production of Protein S or in a method of characterizing Protein S. For example, the invention includes a method of purifying Protein S. The method comprises contacting a sample containing Protein S with a peptide as defined herein under conditions appropriate to form a complex between Protein S and the peptide; removing the complex from the sample; and, optionally, dissociating the complex to release Protein S. Exemplary conditions appropriate to form a complex between Protein S and the peptide are disclosed in the Examples. In some embodiments, the peptide is immobilized to a support, e.g., a solid support, to facilitate recovery of Protein S. For example, in one embodiment, the peptide is immobilized to chromatography stationary phase (e.g., silica, affinity chromatography beads, or chromatography resins), a sample comprising Protein S is applied to the stationary phase such that Protein S-peptide complexes are formed, the remainder of the sample is removed from the stationary phase, and Protein S is eluted from the stationary phase. In this regard, the peptides of the invention are, in one aspect, suitable for use in affinity chromatography techniques.

A method of enhancing thrombin formation in a subject also is provided. The method comprises administering to the subject a peptide provided herein under conditions effective to inhibit Protein S. In this regard, the peptide is administered in an amount and under conditions effective to enhance thrombin formation in the subject. In various aspects of the invention, the subject is "clotting factor-deficient" meaning that the subject suffers from a deficiency in one or more blood factors required for thrombin formation, such as FVIII, FIX, or FXI. Indeed, in one embodiment, the subject is deficient in FVIII. Clotting factor deficiencies are identified by examining the amount of factor in a clinical sample. Practitioners classify hemophilia according to the magnitude of clotting factor deficiency. Subjects suffering from mild hemophilia have approximately 5% to 30% of the normal amount (1 U/ml) of Factor VIII or Factor IX. Moderate hemophilia is characterized by approximately 1% to 5% of normal Factor VIII, Factor IX, or Factor XI levels, while subjects suffering from severe hemophilia have less than 1% of the normal amount of Factor VIII, Factor IX, or Factor XI. Deficiencies can be identified indirectly by activated partial thromboplastin time (APTT) testing. The invention further includes enhancing thrombin formation in a subject that does not suffer from a clotting factor deficiency. The method comprises administering to a subject (e.g., a subject comprising normal, physiological levels of clotting factor) a peptide provided herein under conditions effective to enhance thrombin formation.

In one aspect, the peptide is used for increasing blood clot formation in a subject. The method of increasing blood clot formation comprises administering to the subject a peptide described herein in an amount and under conditions effective to increase blood clot formation. It will be appreciated that the method need not completely restore the coagulation cascade to achieve a beneficial (e.g., therapeutic) effect. Any enhancement or increase in thrombin or blood clot formation that reduces the onset or severity of symptoms associated with clotting factor deficiencies is contemplated. Methods of determining the efficacy of the method in promoting thrombin formation and blood clotting are known in the art and described herein.

The invention further includes a method of treating a blood coagulation disorder in a subject, the method comprising administering to the subject one or more peptides (or peptide complex(es)) of the invention (i.e., any one or more of the peptides described herein), in an amount and under conditions effective to treat the blood coagulation disorder in the subject. "Coagulation disorders" include bleeding disorders (e.g., hypocoagulation) caused by deficient blood coagulation factor activity and deficient platelet activity. Blood coagulation factors include, but are not limited to, Factor V (FV), FVII, FVIII, FIX, FX, FXI, FXIII, FII (responsible for hypoprothrombinemia), and von Willebrand's factor. Factor deficiencies are caused by, for instance, a shortened in vivo half life of the factor, altered binding properties of the factor, genetic defects of the factor, and a reduced plasma concentration of the factor. Coagulation disorders can be congenital or acquired. Coagulation disorders also stem from development of inhibitors or autoimmunity (e.g., antibodies) against clotting factors. In one example, the coagulation disorder is hemophilia A. Alternatively, the coagulation disorder is hemophilia B or hemophilia C.

Platelet disorders are caused by deficient platelet function or abnormally low platelet number in circulation. Low platelet count may be due to, for instance, underproduction, platelet sequestration, or uncontrolled patent destruction. Thrombocytopenia (platelet deficiencies) may be present for various reasons, including chemotherapy and other drug therapy, radiation therapy, surgery, accidental blood loss, and other disease conditions. Exemplary disease conditions that involve thrombocytopenia are: aplastic anemia; idiopathic or immune thrombocytopenia (ITP), including idiopathic thrombocytopenic purpura associated with breast cancer; HIV-associated ITP and HIV-related thrombotic thrombocytopenic purpura; metastatic tumors which result in thrombocytopenia; systemic lupus erythematosus, including neonatal lupus syndrome splenomegaly; Fanconi's syndrome; vitamin B12 deficiency; folic acid deficiency; May-Hegglin anomaly; Wiskott-Aldrich syndrome; chronic liver disease; myelodysplastic syndrome associated with thrombocytopenia; paroxysmal nocturnal hemoglobinuria; acute profound thrombocytopenia following C7E3 Fab (Abciximab) therapy; alloimmune thrombocytopenia, including maternal alloimmune thrombocytopenia; thrombocytopenia associated with antiphospholipid antibodies and thrombosis; autoimmune thrombocytopenia; drug-induced immune thrombocytopenia, including carboplatin-induced thrombocytopenia and heparin-induced thrombocytopenia; fetal thrombocytopenia; gestational thrombocytopenia; Hughes' syndrome; lupoid thrombocytopenia; accidental and/or massive blood loss; myeloproliferative disorders; thrombocytopenia in patients with malignancies; thrombotic thrombocytopenia purpura, including thrombotic microangiopathy manifesting as thrombotic thrombocytopenic purpura/hemolytic uremic syndrome in cancer patients; post-transfusion purpura (PTP); autoimmune hemolytic anemia; occult jejunal diverticulum perforation; pure red cell aplasia; autoimmune thrombocytopenia; nephropathia epidemica; rifampicin-associated acute renal failure; Paris-Trousseau thrombocytopenia; neonatal alloimmune thrombocytopenia; paroxysmal nocturnal hemoglobinuria; hematologic changes in stomach cancer; hemolytic uremic syndromes (e.g., uremic conditions in childhood); and hematologic manifestations related to viral infection including hepatitis A virus and CMV-associated thrombocytopenia. Platelet disorders also include, but are not limited to, Von Willebrand Disease, paraneoplastic platelet dysfunction, Glanzman's thrombasthenia, and Bernard-Soulier disease. Additional bleeding disorders include, but are not limited to, hemorrhagic conditions induced by trauma; a deficiency in one or more contact factors, such as FXI, FXII, prekallikrein, and high molecular weight kininogen (HMWK); vitamin K deficiency; a fibrinogen disorder, including afibrinogenemia, hypofibrinogenemia, and dysfibrinogenemia; and alpha2-antiplasmin deficiency. In one embodiment, the peptide of the invention is used to treat excessive bleeding, such as excessive bleeding caused by surgery, trauma, intracerebral hemorrhage, liver disease, renal disease, thrombocytopenia, platelet dysfunction, hematomas, internal hemorrhage, hemarthroses, hypothermia, menstruation, pregnancy, and Dengue hemorrhagic fever. All of the above are considered "blood coagulation disorders" in the context of the disclosure.

In one aspect, the peptide of the invention is used to reverse the effects (in whole or in part) of one or more anticoagulants in a subject. Numerous anticoagulants are known in the art and include, for instance, heparin; coumarin derivatives, such as warfarin or dicumarol; TFPI; AT III; lupus anticoagulant; nematode anticoagulant peptide (NAPc2); FVIIa inhibitors; active-site blocked FVIIa (FVIIai); active-site blocked FIXa (FIXai); FIXa inhibitors; FXa inhibitors, including fondaparinux, idraparinux, DX-9065a, and razaxaban (DPC906); active-site blocked FXa (FXai); inhibitors of FVa or FVIIIa, including activated protein C (APC) and soluble thrombomodulin; thrombin inhibitors, including hirudin, bivalirudin, argatroban, and ximelagatran; and antibodies or antibody fragments that bind a clotting factor (e.g., FV, FVII, FVIII, FIX, FX, FXIII, FII, FXI, FXII, von Willebrand factor, prekallikrein, or high molecular weight kininogen (HMWK)).

As used herein, "treating" and "treatment" refers to any reduction in the severity and/or onset of symptoms associated with disease or disorder (e.g., a blood coagulation disorder). One of ordinary skill in the art will appreciate that any degree of protection from, or amelioration of, a disorder or symptom associated therewith is beneficial to a subject, such as a human patient. The quality of life of a patient is improved by reducing to any degree the severity of symptoms in a subject and/or delaying the appearance of symptoms. Accordingly, the method in one aspect is performed as soon as possible after it has been determined that a subject is at risk for developing a blood coagulation disorder (e.g., a deficiency in a clotting factor (e.g., FVIII, FIX, or FXI) is detected or inhibitory antibodies are detected) or as soon as possible after a blood coagulation disorder (e.g., hemophilia A, hemophilia B, or hemophilia C) is detected. In an additional aspect, the peptide is administered to protect, in whole or in part, against excessive blood loss during injury or surgery.

In view of the above, the invention provides a peptide (or peptide complex) for use in medicine, i.e., for use in a method for the treatment of a subject, such as a method for the treatment of a disease where the inhibition of Protein S is beneficial. In one aspect, the disease or disorder is a blood coagulation disorder. The subject is suffering from a disease or disorder or is at risk from suffering from a disease or disorder (or adverse biological event, such as excessive blood loss). The method comprises administering to the subject the peptide (or peptide complex) in an amount and under conditions effective to treat or prevent, in whole or in part, the disease or disorder. The invention further provides a peptide (or peptide complex) for use in the manufacture of a medicament. For example, the peptide (or peptide complex) can be used in the manufacture of a medicament for the treatment of a blood coagulation disorder, as described in detail herein.

In some embodiments, it is advantageous to administer to a subject a nucleic acid comprising a nucleic acid sequence encoding a peptide complex or peptide of the invention. Such a nucleic acid, in one aspect, is provided instead of, or in addition to, a peptide complex or peptide. Expression vectors, nucleic acid regulatory sequences, administration methods, and the like, are further described herein and in U.S. Patent Publication No. 20030045498.

The amount of peptide administered to a subject (e.g., a mammal, such as a human) and the conditions of administration (e.g., timing of administration, route of administration, dosage regimen) are sufficient to affect the desired biological response over a reasonable time frame. Purely by way of illustration, in one aspect, the method comprises administering, e.g., from about 0.1 µg/kg to about 100 mg/kg or more. Given the chronic nature of many blood coagulation disorders, it is envisioned that a subject will receive the peptide of the invention over a treatment course lasting weeks, months, or years, and may require one or more doses daily or weekly. In other embodiments, the peptide of the invention is administered to treat an acute condition (e.g., bleeding caused by surgery or trauma, or factor inhibitor/autoimmune episodes in subjects receiving coagulation replacement therapy) for a relatively short treatment period, e.g., one to 14 days.

Suitable methods of administering a physiologically-acceptable composition, such as a pharmaceutical composition comprising a peptide described herein, are well known in the art. Depending on the circumstances, a pharmaceutical composition is applied or instilled into body cavities, absorbed through the skin or mucous membranes, ingested, inhaled, and/or introduced into circulation. In one aspect, a composition comprising a peptide of the invention is administered intravenously, intraarterially, or intraperitoneally to introduce the peptide of the invention into circulation. Non-intravenous administration also is appropriate, particularly with respect to low molecular weight therapeutics. In certain circumstances, it is desirable to deliver a pharmaceutical composition comprising the peptide of the invention orally, topically, sublingually, vaginally, rectally, pulmonary; through injection by intracerebral (intra-parenchymal), intracerebroventricular, intramuscular, intra-ocular, intraportal, intralesional, intramedullary, intrathecal, intraventricular, transdermal, subcutaneous, intranasal, urethral, or enteral means; by sustained release systems; or by implantation devices. If desired, the peptide is administered regionally via intraarterial or intravenous administration feeding a region of interest, e.g., via the femoral artery for delivery to the leg. In one embodiment, the peptide is incorporated into a microparticle as described in, for example, U.S. Pat. Nos. 5,439,686 and 5,498,421, and U.S. Patent Publications 2003/0059474, 2003/0064033, 2004/0043077, 2005/0048127, 2005/0170005, 2005/0142205, 2005/142201, 2005/0233945, 2005/0147689. 2005/0142206, 2006/0024379, 2006/0260777, 2007/0207210, 2007/0092452, 2007/0281031, and 2008/0026068. Alternatively, the composition is administered via implantation of a membrane, sponge, or another appropriate material on to which the desired molecule has been absorbed or encapsulated. Where an implantation device is used, the device in one aspect is implanted into any suitable tissue, and delivery of the desired molecule is in various aspects via diffusion, timed-release bolus, or continuous administration. In other aspects, the peptide is administered directly to exposed tissue during surgical procedures or treatment of injury, or is administered via transfusion of blood procedures. Therapeutic delivery approaches are well known to the skilled artisan, some of which are further described, for example, in U.S. Pat. No. 5,399,363.

To facilitate administration, the peptide or peptide complex in one embodiment is formulated into a physiologically-acceptable composition comprising a carrier (i.e., vehicle, adjuvant, buffer, or diluent). Sterile, physiologically-acceptable carriers are well known in the art. Illustrative pharmaceutical forms suitable for injectable use include without limitation sterile aqueous solutions or dispersions and sterile powders for the extemporaneous preparation of sterile injectable solutions or dispersions (for example, see U.S. Pat. No. 5,466,468). A pharmaceutical composition comprising a peptide provided herein is optionally placed within containers, along with packaging material that provides instructions regarding the use of such pharmaceutical compositions. Generally, such instructions include a tangible expression describing the reagent concentration, as well as, in certain embodiments, relative amounts of excipient ingredients or diluents that may be necessary to reconstitute the pharmaceutical composition.

When appropriate, the peptide or peptide complex of the invention is administered in combination with other substances and/or other therapeutic modalities to achieve an additional or augmented biological effect. Co-treatments include, but are not limited to, plasma-derived or recombinant coagulation factors, hemophilia prophylaxis treatments, immunosuppressants, plasma factor-inhibiting antibody antagonists (i.e., anti-inhibitors), antifibrinolytics, antibiotics, hormone therapy, anti-inflammatory agents (e.g., Non-Steroidal Anti-Inflammatory Drugs (NSAIDs) or steroidal anti-inflammatory substances), procoagulants, and pain relievers. In one aspect, the method is an adjunct therapy to traditional replacement factor treatment regimens involving administration of, e.g., FXIII, FXII, FXI (e.g., HEMOLEVEN® (Laboratoire francais du Fractionnement et des Biotechnologies, Les Ulis, France) and FXI concentrate (BioProducts Laboratory, Elstree, Hertfordshire, UK)), FX, FIX (e.g., BENEFIX® Coagulation Factor IX (Wyeth, Madison, N.J.); ALPHANINE® SD (Grifols, Los Angeles, Calif.); MONONINE® (CSL Behring, King of Prussia, Pa.); BEBULIN-VH™ (Baxter, Deerfield, Ill.); PROFILNINE® SD (Grifols, Los Angeles, Calif.); or PROPLEX T™ (Baxter, Deerfield, Ill.)), FVIII (e.g., ADVATE™ (Baxter, Deerfield, Ill.); HELIXATE® FS (CSL Behring, King of Prussia, Pa.); REFACTO® (Wyeth, Madison, N.J.), XYNTHA™ (Wyeth, Madison, N.J.), KOGENATE® and KOGENATE® FS (Bayer, Pittsburgh, Pa.); ALPHANATE® (Grifols, Los Angeles, Calif.); HEMOPHIL M™ (Baxter, Deerfield, Ill.); KOATE®-DVI (Talecris Biotherapeutics-USA, Research Triangle Park, N.C.); or MONARC-M™ (Baxter, Deerfield, Ill.)), FVIIa (e.g., NOVOSEVEN® FVIIa (Novo Nordisk, Princeton, N.J.) and FVII concentrate (Baxter Bioscience, Vienna, Austria, or BioProducts Laboratory, Elstree, Hertfordshire, UK)), FV, FVa, FII, and/or FIII, to a subject. In some instances, the subject also receives FEIBA VH Immuno™ (Baxter BioScience, Vienna, Austria), which is a freeze-dried sterile human plasma fraction with Factor VIII inhibitor bypassing activity. FEIBA VH Immuno™ contains approximately equal units of Factor VIII inhibitor bypassing activity and Prothrombin Complex Factors (Factors II, VII, IX, and X and protein C). Other exemplary co-treatments include, but are not limited to, prekallikrein, high molecular weight kininogen (HMWK), Von Willebrand's factor, Tissue Factor, and thrombin. Alternatively or in addition, the peptide is co-formulated with one or more different Protein S-binding peptides, such as one or more different peptides of the inventions. In one aspect, administration of the peptide allows a reduction in the dose of co-therapeutic required to achieve a desired biological response. Also optionally, the peptide (or peptide complex) is part of a therapeutic regimen that includes administration of a Tissue Factor Pathway Inhibitor (TFPI)-binding peptide, such as the TFPI-binding peptides described in International Patent Publication No. WO 2013/141965.

The invention thus includes administering to a subject a peptide of the invention (or multiple peptides, or a peptide complex), in combination with one or more additionally suitable substances(s), each being administered according to a regimen suitable for that medicament. Administration strategies include concurrent administration (i.e., substantially simultaneous administration) and non-concurrent administration (i.e., administration at different times, in any order, whether overlapping or not) of the peptide (or peptide complex) and one or more additionally suitable agent(s). It will be appreciated that different components are optionally administered in the same or in separate compositions, and by the same or different routes of administration.

The invention further provides a method for identifying a Protein S-binding compound, such as a Protein S-binding peptide. In one aspect, the method comprises (a) contacting Protein S with a peptide described herein and a test compound (which may be a second peptide) under conditions that allow formation of Protein S-peptide complexes. The method further comprises (b) measuring Protein S-peptide complexes formed in step (a), and (c) comparing the number of Protein S-peptide complexes formed in the presence of the test compound with the number of Protein S-peptide complexes formed in the absence of the test compound. A reduction in the number of Protein S-peptide complexes formed in the presence of the test compound compared to the number of Protein S-peptide complexes formed in the absence of the test compound indicates that the test compound is a Protein S-binding compound. In one aspect, the method further comprises forming Protein S-peptide complexes in the absence of the test compound for comparison in step (c), although this is not required inasmuch as the information may be obtained separately (e.g., from previously prepared reference standards).

Protein S, the peptide, and the test compound are combined simultaneously or sequentially, optionally with washing steps before and/or after addition of the peptide and/or the test compound. In one embodiment, Protein S is contacted with a peptide described herein under conditions that allow formation of Protein S-peptide complexes, unbound peptide is removed, and the remaining Protein S-peptide complexes are contacted with a test compound. Displacement of the peptide from the Protein S-peptide complexes is detected, and indicates that the test compound is a Protein S-binding compound. Displacement is detected by, for example, measuring the number of Protein S-peptide complexes before and after exposure to the test compound.

Protein S-binding peptide complexes are detected and/or measured (quantified) using any suitable detection means, including detection means known in the art for detecting peptides in a sample. For example, in one embodiment of the invention, the peptide of the invention comprises a label that generates a signal. Exemplary labels are described herein and include, e.g., radionuclides, fluorescent dyes, isotopes, enzyme substrates, and enzymes. The method comprises measuring signal generated by Protein S-peptide complexes and comparing signal generated by Protein S-peptide complexes formed in the presence of the test compound with signal generated by Protein S-peptide complexes formed in the absence of the test compound. A reduction in signal from a sample comprising Protein S-peptide complexes exposed to test compound (compared to signal generated by a similar sample of Protein S-peptide complexes not exposed to the test compound) indicates that complex formation has been inhibited or disrupted, and that the test compound is a Protein S-binding compound.

The methods of the invention to identify Protein S-binding compounds are particularly amenable to the various high throughput screening techniques known in the art. Any "test compound" (e.g., small molecule, peptide, protein (such as an antibody or fragment thereof), peptidomimetic, or polynucleotide (DNA or RNA)) is suitable for screening using the methods described herein. If desired, a collection, population, or library of test compounds is screened for Protein S binding (and, optionally, anti-Protein S activity) using the methods described herein. High throughput screening methods embraced by the invention include automated procedures allowing screening of tens to hundreds of thousands of test compounds.

This entire document is intended to be related as a unified disclosure, and it should be understood that all combinations of features described herein are contemplated, even if the combination of features are not found together in the same sentence, or paragraph, or section of this document. For example, where protein therapy is described, embodiments involving polynucleotide therapy (using polynucleotides/vectors that encode the protein) are specifically contemplated, and the reverse also is true. Unless explicitly indicated to the contrary, the description provided herein with respect to one peptide of the invention or method of the invention applies to each and every peptide of the invention and method of the invention, respectively. Also, unless explicitly indicated to the contrary, the description provided herein with respect to a peptide of the invention or use thereof applies to peptide complexes of the invention.

The invention also includes, for instance, all embodiments of the invention narrower in scope in any way than the variations specifically mentioned above. With respect to aspects of the invention described as a genus, all individual species are considered separate aspects of the invention. With respect to aspects of the invention described or claimed with "a" or "an," it should be understood that these terms mean "one or more" unless context unambiguously requires a more restricted meaning. If aspects of the invention are described as "comprising" a feature, embodiments also are contemplated "consisting of" or "consisting essentially of" the feature.

All publications, patents and patent applications cited in this specification are herein incorporated by reference as if each individual publication or patent application were specifically and individually indicated to be incorporated by reference.

EXAMPLES

The invention will be understood more readily by reference to the following examples, which are provided by way of illustration and are not intended to limit the invention.

Example 1

The following example describes production and selection of peptides described herein and characterization Protein S binding.

Peptides were synthesized by Fmoc solid phase synthesis mostly with acetylated N-terminus and amidated C-terminus. Raw products were purified to >90% by HPLC and lyophilized as TFA salts. Lyophilized peptides were stored at <-15° C. Protein S-binding peptide sequences were identified using an mRNA display library and panel of selection assays. The mRNA display method is described in, e.g., International Patent Publication No. WO 2005/051985 and Liu et al., *Methods in Enzymology*, 318, 268-293 (2000). In brief, mRNA is directly linked to its encoded peptide through a puromycin molecule. The peptide-RNA complexes were exposed to full length Protein S in a series of selection rounds during which and Protein S-bound candidate peptide-RNA complexes were isolated and enriched. The RNA encoding peptides with desired properties was reverse transcribed to obtain coding DNA.

The selection rounds included moderate and high stringency selection steps, as well as competitive conditions based on inhibitory anti-Protein S antibodies. The selection process began with five selection rounds of progressive stringency. A library consisting of ~$10^{13}$ random 20-mer peptide-mRNA complexes was incubated for 1 hour with 100 nM biotinylated human Protein S immobilized on paramagnetic streptavidin beads. The binding of peptide/mRNA fusions to Protein S beads and non-coated streptavidin control beads was monitored by scintillation measurement of radioactive-labeled peptide-mRNA complexes. Unbound peptide-mRNA complexes were removed by four washing steps. Subsequently, peptide/mRNA fusions bound to the Protein S-coated beads were amplified and subjected to the next round of selection. A progressive enrichment of Protein S-binding peptide-mRNA complexes was observed over five selection rounds. For example, high stringency selection of peptides identified in round 2 eliminated ~99% of the population, leaving a subpopulation of high affinity binders.

Unique peptide sequences identified by mRNA display (296 peptides) were synthesized as N-terminally biotinylated variants in order to facilitate affinity testing. Peptides with detectable affinity for Protein S in the various screening assays described above were further characterized in an ELISA-based EC50 binding assay. Briefly, Nunc Polysorb MTP wells were coated with 50 µl Protein S (3 µg/ml) and blocked with 2% yeast extract and 0.1% Tween80. Biotinylated peptides were incubated in Protein S-coated wells and blocked control wells (without Protein S). After several washing steps, bound peptide was detected by Streptavidin-HRP using TMB as chromogenic substrate. EC50 values were obtained from peptide titration curves by non-linear regression of the background-corrected and normalized binding signals. The affinities of the peptides range from two-digit micromolar to sub-nanomolar (EC50). Exemplary peptides identified by the mRNA display and screening assays include JBS0684 (SEQ ID NO: 1) and JBS2512 (SEQ ID NO: 2).

Example 2

This example describes the generation of additional Protein S binding peptides and characterization of Protein S binding. This example further describes plasma-based hemophilia model and demonstrates the Protein S-inhibitory activity of the peptides described herein.

Peptides identified in Example 1 were subjected to substitution analysis to further investigate Protein S binding and to identify peptides with improved activity. For example, each amino acid position of parent peptide JBS2512 was separately replaced by a set of eight representative amino acids (Ala, Asp, Phe, Gly, Leu, Lys, Ser, Pro). Thus, approximately 160 new peptide candidates were created from one parent peptide. Each of these new peptide candidates carried a single amino acid exchange compared to the parent peptide.

The new peptide candidates were synthesized (purity>60%) and screened for affinity in a competitive binding assay (ELISA IC50) and activity in a thrombin generation assay (CAT). The competition (IC50) ELISA was performed using biotinylated tracer peptide JBS0684 to compete for Protein S-binding with candidate peptides. Peptides that compete with the tracer bind the same region of Protein S as the tracer (and each other). Ninety-six well PolySorp plates (Nunc) were coated with 3 µg/mL Protein S in coating buffer (15 mM $Na_2CO_3$, 35 mM $NaHCO_3$, pH 9.6) over night. Plates were washed three times with wash buffer (HNaT: 175 mM NaCl, 25 mM HEPES, 5 mM $CaCl_2$, 0.1% Tween 80, pH 7.35), and blocked with 100 µl 2% yeast extract in HNaT for at least 1 hour. Plates were then washed three times with HNaT. JBS0684 was applied at a concentration corresponding to the EC90 value determined in the binding ELISA. A competitor stock solution of peptide (10 mM) was diluted 1/33.3 in HNaT without HSA, and a serial 1/3 dilution was prepared with HNaT with 3% DMSO. The dilution was further diluted with the biotinylated tracer peptide in a ratio of 1:6 (20 µl competitor dilution and 100 µl tracer peptide). The mixture of competitor and tracer peptide was applied to the Protein S-coated microtiter plate and incubated for 1.5 hours. The plates were washed three times with HNaT. Peptide-Protein S binding was detected by applying HRP-conjugated streptavidin to the microtiter plate, incubating the mixture for one hour, washing the plate three times with HNaT, applying TMB (3,3'5,5'-Tetramethylbenzidin), and detecting the subsequent chromogenic conversion of TMB by HRP. IC50 measurements of peptides are provided herein (see, e.g., Table 3).

Peptides also were tested for improvement of Protein S/APC-dependent thrombin generation in hemophilic plasma using a CAT assay. Protein S enhances the anticoagulation of APC in plasma. The CAT assay quantifies the effect of Protein S on APC-mediated thrombin generation initiated via the extrinsic coagulation pathway (Nicolaes, *Blood Coagul. Fibrinolysis*, 8:28 (1997)). APC (35 nM) and Protein S (25 nM) was added to Protein S-depleted plasma, and plasma samples were incubated with high titer heat inactivated anti-human FVIII plasma raised in goat (4490 BU/ml; Baxter BioScience, Vienna, Austria; 50 BU/ml final plasma concentration). Thrombin formation in plasma was followed by calibrated automated thrombography (CAT) in a Fluoroskan Ascent® reader (Thermo Labsystems, Helsinki, Finland) and quantified via the thrombin peak-height. Thrombin generation was determined at high tissue factor (TF) concentration in the absence and in the presence of APC at a concentration that reduces the peak height to ~20%. The inhibitory effect of peptides described herein on the APC cofactor activity of Protein S (PS) in plasma was measured in FVIII-inhibited pooled normal plasma supplemented with APC. Complete (100%) Protein S/APC inhibition is the height of the thrombin peak without addition of APC. Lack of (0%) PS/APC inhibition correlates to the thrombin peak-height value with a certain amount of APC. Peptides were ranked by their normalized values in comparison to the mean of wild-type controls including SD at two defined peptide concentrations (EC50 and EC90).

Exemplary conditions for the CAT assay are as follows. Protein S-depleted plasma was supplemented with 35 nM APC and 35 nM Protein S. Stock APC was diluted with 10 pM TF and 15 µM PL. Lyophilized peptides were dissolved in 100% DMSO to a 5 mM stock concentration and further diluted with HNABSA5-buffer+0.1% Tween80. The final peptide plasma concentrations were 140 nM (EC90 wild-types) and 90 nM (EC50 wildtypes). In a 96 well Immulon 2HB (transparent), U-bottom (ThermoElectron) plate was mixed 80 µl plasma (+CTI+Z994-5), 10 µl peptide dilution, and 10 µl APC-TF-PL-MIX or Calibrator. Thrombin generation was initiated by dispensing 20 µL of FluCa reagent containing fluorogenic substrate and HEPES-buffered CaCl$_2$ (100 mM) into each well. Fluorescence intensity was recorded at 37° C. using the Fluoroskan Ascent® reader (filters 390 nm excitation and 460 nm emission). The parameters of the resulting thrombin generation curves were calculated using the Thrombinoscope™ software (Thrombinoscope) and thrombin calibrator to correct for inner filter and substrate consumption effects (Hemker, *Pathophysiol Haemost Thromb*, 33: 415 (2003)).

For both the competitive binding assay and the CAT assay, peptide candidates were characterized as having better, similar, or less activity than the parent. The analysis revealed enhancing substitutions at six different positions located within the three N-terminal positions and positions 13, 15 and 17. Tolerated substitutions (substitutions that did not negatively affect activity) were identified at several positions, including positions 1-3, 11, 13, 15, 17, 18, and 20. Selected peptides with enhancing substitutions were re-synthesized (purity>90%) and run in the ELISA IC50 assay, the results of which are provided in Table 2.

TABLE 2

| Peptide | Sequence | SEQ ID NO. | IC50 [nM] | CAT EC50 [nM] |
|---|---|---|---|---|
| JBS2512 | Ac-TGHVSAGWYDYNFDHYREFT-NH2 | 2 | 3.9 | 24 |
| JBS2516 | Ac-TAHVSAGWYDYNFDHYREFT-NH2 | 6 | 3.3 | 21 |
| JBS2526 | Ac-TGHVSAGWYDYNADHYREFT-NH2 | 16 | 3.6 | 19 |
| JBS2528 | Ac-TGHVSAGWYDYNFDAYREFT-NH2 | 18 | 5.2 | 23 |
| JBS2546 | Ac-TGHVSAGWYDYNFDDYREFT-NH2 | 36 | 6.8 | 30 |
| JBS2552 | Ac-GGHVSAGWYDYNFDHYREFT-NH2 | 42 | 5.5 | 24 |
| JBS2572 | Ac-TGLVSAGWYDYNFDHYREFT-NH2 | 62 | 2.5 | 14 |
| JBS2582 | Ac-TGHVSAGWYDYNLDHYREFT-NH2 | 72 | 2.3 | 15 |
| JBS2584 | Ac-TGHVSAGWYDYNFDLYREFT-NH2 | 74 | 2.7 | 9 |
| JBS2586 | Ac-TGHVSAGWYDYNFDHYLEFT-NH2 | 76 | 2.6 | 19 |
| JBS2591 | Ac-TKHVSAGWYDYNFDHYREFT-NH2 | 81 | 4.2 | n.d. |
| JBS2592 | Ac-TGKVSAGWYDYNFDHYREFT-NH2 | 82 | 5.6 | 68 |
| JBS2602 | Ac-TGHVSAGWYDYNKDHYREFT-NH2 | 92 | 3.4 | 30 |
| JBS2604 | Ac-TGHVSAGWYDYNFDKYREFT-NH2 | 94 | 4.1 | 19 |
| JBS2625 | Ac-TGHVSAGWYDYNFDHYFEFT-NH2 | 115 | 1.6 | 29 |
| JBS2629 | Ac-TPHVSAGWYDYNFDHYREFT-NH2 | 119 | 3.1 | 25 |
| JBS2661 | Ac-TGHVSAGWYDYNFDSYREFT-NH2 | 151 | 2.8 | 16 |

Many peptides from the mRNA display selections and the substitution analysis showed very good inhibition of Protein S/APC cofactor activity in the plasmatic system at low peptide concentration. JBS2512, for example, demonstrated very good binding affinity to Protein S and a low EC50 value in the CAT assay. JBS2572 has a non-homologous His to Leu substitution at position 3 which increases the affinity and the activity in the CAT-assay 1.6-fold compared to JBS2512. In the competition binding assay (ELISA IC50), JBS2572 demonstrated an IC50 of 2.5±0.3 nM. JBS2572 improved PS/APC-dependent thrombin generation in hemophilic plasma.

Peptides also were characterized in a competition, homogenous europium-based TR-FRET assay (LANCE IC50 assay) using JBS0684 as a tracer (i.e., competitor for Protein S binding). The following reagents were mixed together in a Perkin-Elmer ProxiPlate MTP well (indicated concentration is the final concentration): Eu-labeled Protein S (10 nM), Ulight™-labeled Streptavidin (100 nM), tracer (JBS0684 (300 nM)), and peptide (titrated in three-fold dilution steps). The final volume was 50 µl/well. The reaction mix was incubated for 1 hour at room temperature, then the fluorescence emission at 665 nm was recorded on a multi-mode reader (SpectraMax® M5, Molecular Devices) using the following instrument settings: Ex 340 nm, Em 665 nm, delay 50 µsec, integration 100 µsec, reads 100. Binding of tracer peptides to soluble europium-labeled Protein S was detected by Streptavidin labeled with an acceptor fluorophor (ULight™). Inhibition of tracer-binding to Protein S by a non-biotinylated peptide results in a decrease of TR-FRET between the Eu-labeled Protein S and ULight™-labeled Streptavidin. IC50 values were obtained from peptide titration curves at constant tracer concentration using non-linear regression of the fluorescence emission signals at 665 nm. JBS2572 demonstrated an IC50 of 49±6 nM using a Molecular Devices M5 reader. Additional measurements were taken using a Tecan F500 reader, which enables the use of lower Protein S (2 nM) and tracer concentrations (60 nM); the LANCE IC50 value for JBS2572 was in the range of 10 nM.

Protein S affinity also was determined via Biacore (Biacore 3000 or Biacore T200) using human full-length Protein S and human GAS6. Briefly, 1000 RU of Protein S or GAS6 were immobilized on a CMS chip. In order to probe the kinetics of Protein S binding peptides to Protein S, the peptides were injected at various concentrations in a HBS-buffer containing 3 mM CaCl$_2$ and 1% DMSO to the flow cell and allowed to interact with the immobilized proteins on the sensor chip. The chip could be regenerated with 4 M MgCl$_2$ in HBS-buffer. Sensorgrams were fitted to a Langmuir binding model for the determination of $k_{on}$ and $k_{off}$ and the calculation of $K_D$. Peptides were tested on their specificity to Protein S with peptide binding studies on the anti-target GAS6. JBS2572 demonstrated $K_D$ for binding to Protein S of 6 nM ($k_{on}$=2.48×10$^5$ 1/Ms, $k_{off}$=1.48×10$^{-3}$ 1/s) at 25° C. At 37° C., the $K_D$ was 3.8×10$^{-9}$ (4 nM) ($k_{on}$=1.14× 10$^6$ 1/Ms, $k_{off}$: 4.31×10$^{-3}$ 1/s).

Examples 1 and 2 provide exemplary methods of generating and characterizing Protein S-binding peptides (e.g., Protein S-inhibitory peptides). Hundreds of peptides were identified that bind to human Protein S. Substitution analysis of an exemplary peptide generated additional Protein S-binding peptides, and demonstrated that substitutions within the Protein S-binding peptide were tolerated (i.e., retained affinity for Protein S) and, in some instances, improved affinity. Many peptides bound human Protein S with a dissociation constant or IC50 of <10 µM. The Examples further demonstrates that peptides of the invention inhibit Protein S cofactor activity in a plasma assay system with an EC50 of <10 µM. In vitro activity was demonstrated in the presence of physiological Protein S concentrations.

Example 3

This example demonstrates that peptides of the invention exhibit reduced affinity for non-Protein S proteins ("anti-targets").

Protein S comprises domains highly homologous to regions of other coagulation system proteins containing Gla-domains (such as, e.g., GAS6 (the protein encoded by the Growth Arrest Specific-6 gene), Factor VII, Factor IX, Factor X, Protein C, Protein Z, and prothrombin), EGF-like domains (such as, e.g., GAS6, Factor VII, Factor IX, Factor X, Protein C, Protein Z, and thrombomodulin), and laminin G-like domains (such as GAS6). These other coagulation system proteins, therefore, are potential anti-targets. Human GAS6 was used to determine anti-target binding because it is the most similar to Protein S (42% identity, 57% consensus sequence).

Interactions with the anti-target GAS6 were measured via Biacore (surface plasmon resonance) (see Example 2). The maximum signal from the interaction of the peptides with human GAS6 was much lower than the signals obtained with Protein S as interaction partner. Kinetic analysis of the low GAS6 binding signals was error prone, and sensorgrams were reviewed visually to estimate anti-target binding. JBS2572 showed no specific binding to GAS6 at 1 μM concentration. The affinity of JBS2572 for the anti-target was at least 10 times less (indeed, at least 150 times less) than the affinity of the peptides for human Protein S. The data provided by this example confirm that peptides described herein specifically bind Protein S.

Example 4

Peptides with increased affinity for human Protein S were obtained from a partially randomized library based on the sequence of JBS2572 (SEQ ID NO: 62). Selection of high affinity binders was accomplished by mRNA display and screening assays using methods similar to those described in Examples 1 and 2. The selection conditions applied to the peptide pool resulted in increased binding signals to Protein S. Enriched peptide pools from three rounds of selection were sequenced, which yielded the amino acid sequences of e.g., JBS3216-3223 (SEQ ID NO: 462-469) and JBS3231-3314 (SEQ ID NO: 477-560). Several peptides from the affinity maturation pool were chemically modified. JBS3319 was conjugated to 40 kD PEG moiety to yield JBS3318 (SEQ ID NO: 564). A tetramer of JBS3319 monomers together with a four arm 10 kD PEG moiety yielded JBS3321 (SEQ ID NO: 567). JBS3179 (SEQ ID NO: 433) is a JBS3206 tetramer comprising a 40 kD PEG moiety. JBS3322 (SEQ ID NO: 568) is a JBS3206 monomer comprising a 40 kD PEG moiety.

Protein S binding affinity was evaluated for 18 representative peptides (JBS3216, JBS3218, JBS3221, JBS3223, JBS3232, JBS3235, JBS3236, JBS3258, JBS3260, JBS3263, JBS3274, JBS3281, JBS3283, JBS3284, JBS3296, JBS3297, JBS3306, and JBS3314) via Biacore and LANCE IC50 assays. The peptides' ability to inhibit Protein S activity was determined via CAT assay, and plasma stability was also examined.

Affinity and activity of all 18 peptides was improved compared to parent JBS2572. The results demonstrate that multiple substitutions within the amino acid sequence of the peptides described herein are tolerated (i.e., does not destroy the ability of the peptide to bind Protein S). For example, JBS3216, which comprises substitutions at seven amino acid positions in the sequence of JBS2572 (positions 1-3, 13, 15, 17, and 20) and JBS2512, demonstrated a higher affinity for Protein S ($K_D$=0.2 nM) than the parent peptide JBS2572 ($K_D$=4 nM). Indeed, the optimized peptides demonstrated pM-affinities (20-fold improvement) with a $k_{off}$ in the range of $1\times10^{-4}$ to $6\times10^{-4}$ $s^{-1}$. Activity and stability were improved up to 1.5-fold. Exemplary Biacore results using methods similar to those described above are provided in Table 4. Plasma stability was determined in pooled normal human plasma and mouse plasma at 37° C.; exemplary results also are provided in Table 3. Stability analysis also revealed that, after 24 hours of incubation in human plasma, greater than 80% binding activity of JBS3318, JBS3179, and JBS3322 and ~50% of binding activity of JBS3216 remained. JBS3179, JBS3318, and JBS3322 also were determined not to interact with GAS6, an anti-target (at 1 μM).

TABLE 3

| Peptide | $k_{on}$ (1/Ms) | $k_{off}$ (1/s) | $K_D$ (nM) | Stability in mouse plasma; 4 hours [%] | Stability in human plasma; 6 hours [%] |
|---|---|---|---|---|---|
| JBS3179 | 4.10E+05 | 1.79E−04 | 0.4 | 89 ± 13 | 105 ± 7 |
| JBS3318 | 1.52E+05 | 2.13E−04 | 1.4 | 102 ± 20 | 114 ± 8 |
| JBS3322 | 7.80E+04 | 2.78E−04 | 3.6 | 91 ± 26 | 131 ± 14 |
| JBS3216 | 1.14E+06 | 2.33E−04 | 0.2 | 66 ± 23 | 80 ± 2 |
| JBS3263 | 6.29E+05 | 2.64E−04 | 0.4 | 56 ± 6 | 74 ± 12 |
| JBS3283 | 7.35E+05 | 3.22E−04 | 0.4 | 94 ± 6 | 90 ± 9 |
| JBS3306 | 1.00E+06 | 4.02E−04 | 0.4 | 80 ± 14 | 84 ± 12 |
| JBS3321 | 1.58E+06 | 3.88E−05 | 0.02 | 94 ± 12 | 99 ± 6 |

The inhibitory activity of the peptides was analyzed in the CAT assay (i.e., thrombin-based, APC resistance test) in plasmas from three individuals with severe hemophilia A. JBS3179, JBS3318, and JBS3322, for example, improved Protein S/APC dependent thrombin generation in the plasmas with an EC50 lower than 100 nM. JBS3179 demonstrated an EC50 of 6 nM in the CAT assay, and JBS3216 also efficiently improved coagulation in a CAT assay in human hemophilia A patient plasma (EC50=85 nM). JBS3216 also improved thrombin generation in several non-human mammals: cynomolgous monkey, marmoset monkey, pig, sheep, dog, rabbit, rat, and mouse.

JBS3179 also demonstrated beneficial in vivo activity. The peptide dose-dependently reduced bleeding in a hemophilia mouse tail cut model when administered with 25 U/kg ADVATE, significantly reduced joint bleeding in a hemarthrosis hemophilia A mouse model when co-administered with sub-efficient FVIII doses, and improved ex vivo thrombin generation in a rabbit model of induced hemophilia.

Example 5

This example describes additional peptides that bind Protein S and demonstrates that variability within the amino acid sequences of the peptides described herein is tolerated with respect to Protein S binding and inhibition.

Several peptides having multiple substitutions in the JBS2572 amino acid sequence were synthesized and evaluated using LANCE IC50 and CAT assays described above. For the assays, pooled normal plasma was supplemented with 3 nM APC and triggered with 6 pM TF, and 15 μM phospholipids (DOPC/POPS 80/20). Stock APC was diluted with TF-PL-MIX to 24 nM (plasma concentration: 3 nM). Exemplary results are provided in Table 4. The analysis focused on positions 1, 4, 5, 13, 15 and 17, and demonstrated that multiple substitutions within the parent sequence are tolerated and, in many instances, increased binding affinity and inhibitory activity compared to peptides having single substitutions within the JBS2572 parent sequence.

TABLE 4

| Peptide | Sequence | SEQ ID NO | Substitutions in JBS2572 | LANCE IC50 [nM] | CAT EC50 [nM] |
|---|---|---|---|---|---|
| JBS2572 | Ac-TGLVSAGWYDYNFDHYREFT-NH2 | 62 | Parent | 9.7 | 151 |
| JBS3186 | Ac-TGLVSAGWYDYNFDTYMEFT-NH2 | 438 | H15T, R17M | 2.6 | 176 |
| JBS3188 | Ac-TGLVSAGWYDYNFDTYTEFT-NH2 | 440 | H15T, R17T | 2.9 | 155 |
| JBS3189 | Ac-TGLVSAGWYDYNFDVYTEFT-NH2 | 441 | H15V, R17T | 5.0 | 281 |
| JBS3190 | Ac-YGLVSAGWYDYNFDTYREFT-NH2 | 442 | H15T, T01Y | 1.6 | 130 |
| JBS3191 | Ac-YGLVSAGWYDYNFDVYREFT-NH2 | 443 | H15V, T01Y | 1.6 | 147 |
| JBS3192 | Ac-TGLVEAGWYDYNFDTYREFT-NH2 | 444 | H15T, S05E | 2.8 | 117 |
| JBS3193 | Ac-TGLVEAGWYDYNFDVYREFT-NH2 | 445 | H15V, S05E | 2.5 | 116 |
| JBS3194 | Ac-TGLVSAGWYDYNNDTYREFT-NH2 | 446 | H15T, F13N | 1.8 | 122 |
| JBS3195 | Ac-TGLVSAGWYDYNNDVYREFT-NH2 | 447 | H15V, F13N | 2.0 | 139 |
| JBS3196 | Ac-YGLVSAGWYDYNFDHYMEFT-NH2 | 448 | R17M, T01Y | 2.2 | 155 |
| JBS3197 | Ac-TGLVEAGWYDYNFDHYMEFT-NH2 | 449 | R17M, S05E | 6.1 | 146 |
| JBS3198 | Ac-TGLVSAGWYDYNNDHYMEFT-NH2 | 450 | R17M, F13N | 2.5 | 149 |
| JBS3201 | Ac-YGLVEAGWYDYNNDTYMEFT-NH2 | 453 | T01Y, S05E, F13N, 15T, R17M | 1.9 | 127 |
| JBS3202 | Ac-TGL-Tle-SAGWYDYNFDTYREFT-NH2 | 454 | V4Tle, H15T | 1.6 | 129 |
| JBS3203 | Ac-TGL-Tle-SAGWYDYNFDHYMEFT-NH2 | 455 | V4Tle, R17M | 1.8 | 127 |

Example 6

This example demonstrates the ability of peptides described herein to interrupt Protein S (PS) binding to C4BP. C4BP is an octopus-like molecule which contains seven identical α-chains (MW 70 kDa) and a smaller β-chain (45 kDa). Protein S binds to the β-chain, and Protein S complex formation with C4BP abolishes the APC cofactor activity of Protein S. The dissociation constant of Protein S and C4BP in presence of calcium ions is ~0.5 nM. Due to this high affinity, the level of free PS corresponds to its molar excess over β-chain-containing C4BP.

To investigate the effect of the peptides described herein on PS/C4BP complexes, a LANCE IC50 assay was established using methods similar to those described above. JBS2572 or JBS3216 was added to a preformed C4BP/PS complex. Changes in the complex concentration were followed by recording the TR-FRET signal. For both peptides, a time- and concentration-dependent dissociation of the C4BP/PS complex was observed. The IC50 of JBS3216 was 0.3 nM, and the IC50 of JBS2572 was 2 nM. The time-dependency of the complex reduction was similar for both peptides. After two hours of incubation in the presence of 100 nM JBS2572 or JBS3216, the C4BP/PS complex was reduced to 60% and 50%, respectively. In addition, binding of biotinylated JBS2572 to Protein S was inhibited by C4BP in the LANCE IC50 assay. Pull-down experiments where JBS2697 was coupled to streptavidin sepharose and incubated for one hour at room temperature with (a) Protein S (1.6 pmol) (b) C4BP (8.5 pmol) and (c) Protein S (1.6 pmol)+C4BP (8.5 pmol) supported the results from the modified LANCE IC50 assay. JBS2697 interacted with free Protein S only from experiment (a) with Protein S alone and from experiment (c) with the C4BP-Protein S mixture.

These findings demonstrate that the peptides described herein can reduce the fraction of preformed C4BP/PS complex at nM concentration in a time-dependent manner. Disruption of the C4BP/PS interaction by the peptides (and vice versa) may stem from competitive or allosteric inhibition of the C4BP/PS complex. The binding site of C4BP on Protein S was mapped to the Laminin G-domains of Protein S with a $K_D$ of 0.1-0.6 nM. Thus, Laminin G domains appear to be involved in the interaction between the peptides and Protein S. Binding site mapping experiments using limited proteolysis support the observation. N-terminal sequencing of proteolytic fragments identified a peptide-protected region within the LG1 domain of Protein S, strongly suggesting the LG1 domain as the peptides' target binding region.

SEQUENCE LISTING (2924 sequences)

SEQ ID NO: 1 - protein, 21 aa, Artificial Sequence
  Synthetic peptide
  MISC_FEATURE (1)..(1): N-terminal Biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XTGHVSAGWYDYNFDHYREFT

SEQ ID NO: 2 - protein, 20 aa, Artificial Sequence
  Synthetic peptide
  MISC_FEATURE (1)..(1): N-terminal acetylation
  MISC_FEATURE (20)..(20): C-terminal amidation
TGHVSAGWYDYNFDHYREFT

SEQ ID NO: 3 - protein, 20 aa, Artificial Sequence
  Synthetic peptide
  MISC_FEATURE (1)..(1): N-terminal acetylation
  MISC_FEATURE (20)..(20): C-terminal amidation
ATFYGTNHFVERDWHSDYYG

SEQ ID NO: 4 - protein, 20 aa, Artificial Sequence
  Synthetic peptide
  MISC_FEATURE (1)..(1): N-terminal acetylation
  MISC_FEATURE (20)..(20): C-terminal amidation
WYFYTGDHEHSFNVGYARDT

SEQ ID NO: 5 - protein, 20 aa, Artificial Sequence
  Synthetic peptide
  MISC_FEATURE (1)..(1): N-terminal acetylation
  MISC_FEATURE (20)..(20): C-terminal amidation
AGHVSAGWYDYNFDHYREFT

SEQ ID NO: 6 - protein, 20 aa, Artificial Sequence
  Synthetic peptide
  MISC_FEATURE (1)..(1): N-terminal acetylation
  MISC_FEATURE (20)..(20): C-terminal amidation
TAHVSAGWYDYNFDHYREFT

SEQ ID NO: 7 - protein, 20 aa, Artificial Sequence
  Synthetic peptide
  MISC_FEATURE (1)..(1): N-terminal acetylation
  MISC_FEATURE (20)..(20): C-terminal amidation
TGAVSAGWYDYNFDHYREFT

SEQ ID NO: 8 - protein, 20 aa, Artificial Sequence
  Synthetic peptide
  MISC_FEATURE (1)..(1): N-terminal acetylation
  MISC_FEATURE (20)..(20): C-terminal amidation
TGHASAGWYDYNFDHYREFT

SEQ ID NO: 9 - protein, 20 aa, Artificial Sequence
  Synthetic peptide
  MISC_FEATURE (1)..(1): N-terminal acetylation
  MISC_FEATURE (20)..(20): C-terminal amidation
TGHVAAGWYDYNFDHYREFT

SEQ ID NO: 10 - protein, 20 aa, Artificial Sequence
  Synthetic peptide
  MISC_FEATURE (1)..(1): N-terminal acetylation
  MISC_FEATURE (20)..(20): C-terminal amidation
TGHVSAAWYDYNFDHYREFT

SEQ ID NO: 11 - protein, 20 aa, Artificial Sequence
  Synthetic peptide
  MISC_FEATURE (1)..(1): N-terminal acetylation
  MISC_FEATURE (20)..(20): C-terminal amidation
TGHVSAGAYDYNFDHYREFT

SEQ ID NO: 12 - protein, 20 aa, Artificial Sequence
  Synthetic peptide
  MISC_FEATURE (1)..(1): N-terminal acetylation
  MISC_FEATURE (20)..(20): C-terminal amidation
TGHVSAGWADYNFDHYREFT

SEQ ID NO: 13 - protein, 20 aa, Artificial Sequence
  Synthetic peptide
  MISC_FEATURE (1)..(1): N-terminal acetylation
  MISC_FEATURE (20)..(20): C-terminal amidation
TGHVSAGWYAYNFDHYREFT

SEQ ID NO: 14 - protein, 20 aa, Artificial Sequence
  Synthetic peptide
  MISC_FEATURE (1)..(1): N-terminal acetylation
  MISC_FEATURE (20)..(20): C-terminal amidation
TGHVSAGWYDANFDHYREFT

SEQ ID NO: 15 - protein, 20 aa, Artificial Sequence
  Synthetic peptide
  MISC_FEATURE (1)..(1): N-terminal acetylation
  MISC_FEATURE (20)..(20): C-terminal amidation
TGHVSAGWYDYAFDHYREFT

SEQ ID NO: 16 - protein, 20 aa, Artificial Sequence
  Synthetic peptide
  MISC_FEATURE (1)..(1): N-terminal acetylation
  MISC_FEATURE (20)..(20): C-terminal amidation
TGHVSAGWYDYNADHYREFT

SEQ ID NO: 17 - protein, 20 aa, Artificial Sequence
  Synthetic peptide
  MISC_FEATURE (1)..(1): N-terminal acetylation
  MISC_FEATURE (20)..(20): C-terminal amidation
TGHVSAGWYDYNFAHYREFT

SEQ ID NO: 18 - protein, 20 aa, Artificial Sequence
  Synthetic peptide
  MISC_FEATURE (1)..(1): N-terminal acetylation
  MISC_FEATURE (20)..(20): C-terminal amidation
TGHVSAGWYDYNFDAYREFT

SEQ ID NO: 19 - protein, 20 aa, Artificial Sequence
  Synthetic peptide
  MISC_FEATURE (1)..(1): N-terminal acetylation
  MISC_FEATURE (20)..(20): C-terminal amidation
TGHVSAGWYDYNFDHAREFT

SEQ ID NO: 20 - protein, 20 aa, Artificial Sequence
  Synthetic peptide
  MISC_FEATURE (1)..(1): N-terminal acetylation
  MISC_FEATURE (20)..(20): C-terminal amidation
TGHVSAGWYDYNFDHYAEFT

SEQ ID NO: 21 - protein, 20 aa, Artificial Sequence
  Synthetic peptide
  MISC_FEATURE (1)..(1): N-terminal acetylation
  MISC_FEATURE (20)..(20): C-terminal amidation
TGHVSAGWYDYNFDHYRAFT

SEQ ID NO: 22 - protein, 20 aa, Artificial Sequence
  Synthetic peptide
  MISC_FEATURE (1)..(1): N-terminal acetylation
  MISC_FEATURE (20)..(20): C-terminal amidation
TGHVSAGWYDYNFDHYREAT

SEQ ID NO: 23 - protein, 20 aa, Artificial Sequence
  Synthetic peptide
  MISC_FEATURE (1)..(1): N-terminal acetylation
  MISC_FEATURE (20)..(20): C-terminal amidation
TGHVSAGWYDYNFDHYREFA

SEQ ID NO: 24 - protein, 20 aa, Artificial Sequence
  Synthetic peptide
  MISC_FEATURE (1)..(1): N-terminal acetylation
  MISC_FEATURE (20)..(20): C-terminal amidation
DGHVSAGWYDYNFDHYREFT

SEQ ID NO: 25 - protein, 20 aa, Artificial Sequence
  Synthetic peptide
  MISC_FEATURE (1)..(1): N-terminal acetylation
  MISC_FEATURE (20)..(20): C-terminal amidation
TDHVSAGWYDYNFDHYREFT

SEQ ID NO: 26 - protein, 20 aa, Artificial Sequence
  Synthetic peptide
  MISC_FEATURE (1)..(1): N-terminal acetylation
  MISC_FEATURE (20)..(20): C-terminal amidation
TGDVSAGWYDYNFDHYREFT

SEQ ID NO: 27 - protein, 20 aa, Artificial Sequence
  Synthetic peptide
  MISC_FEATURE (1)..(1): N-terminal acetylation
  MISC_FEATURE (20)..(20): C-terminal amidation
TGHDSAGWYDYNFDHYREFT

SEQ ID NO: 28 - protein, 20 aa, Artificial Sequence
  Synthetic peptide
  MISC_FEATURE (1)..(1): N-terminal acetylation
  MISC_FEATURE (20)..(20): C-terminal amidation
TGHVDAGWYDYNFDHYREFT

SEQ ID NO: 29 - protein, 20 aa, Artificial Sequence
  Synthetic peptide
  MISC_FEATURE (1)..(1): N-terminal acetylation
  MISC_FEATURE (20)..(20): C-terminal amidation
TGHVSDGWYDYNFDHYREFT

SEQ ID NO: 30 - protein, 20 aa, Artificial Sequence
  Synthetic peptide
  MISC_FEATURE (1)..(1): N-terminal acetylation
  MISC_FEATURE (20)..(20): C-terminal amidation
TGHVSADWYDYNFDHYREFT

SEQ ID NO: 31 - protein, 20 aa, Artificial Sequence
  Synthetic peptide
  MISC_FEATURE (1)..(1): N-terminal acetylation
  MISC_FEATURE (20)..(20): C-terminal amidation
TGHVSAGDYDYNFDHYREFT

SEQ ID NO: 32 - protein, 20 aa, Artificial Sequence
  Synthetic peptide
  MISC_FEATURE (1)..(1): N-terminal acetylation
  MISC_FEATURE (20)..(20): C-terminal amidation
TGHVSAGWDDYNFDHYREFT

SEQ ID NO: 33 - protein, 20 aa, Artificial Sequence
  Synthetic peptide
  MISC_FEATURE (1)..(1): N-terminal acetylation
  MISC_FEATURE (20)..(20): C-terminal amidation
TGHVSAGWYDDNFDHYREFT

SEQ ID NO: 34 - protein, 20 aa, Artificial Sequence
  Synthetic peptide
  MISC_FEATURE (1)..(1): N-terminal acetylation
  MISC_FEATURE (20)..(20): C-terminal amidation
TGHVSAGWYDYDFDHYREFT

SEQ ID NO: 35 - protein, 20 aa, Artificial Sequence
  Synthetic peptide
  MISC_FEATURE (1)..(1): N-terminal acetylation
  MISC_FEATURE (20)..(20): C-terminal amidation
TGHVSAGWYDYNDDHYREFT

SEQ ID NO: 36 - protein, 20 aa, Artificial Sequence
  Synthetic peptide
  MISC_FEATURE (1)..(1): N-terminal acetylation
  MISC_FEATURE (20)..(20): C-terminal amidation
TGHVSAGWYDYNFDDYREFT

SEQ ID NO: 37 - protein, 20 aa, Artificial Sequence
  Synthetic peptide
  MISC_FEATURE (1)..(1): N-terminal acetylation
  MISC_FEATURE (20)..(20): C-terminal amidation
TGHVSAGWYDYNFDHDREFT

SEQ ID NO: 38 - protein, 20 aa, Artificial Sequence
  Synthetic peptide
  MISC_FEATURE (1)..(1): N-terminal acetylation
  MISC_FEATURE (20)..(20): C-terminal amidation
TGHVSAGWYDYNFDHYDEFT

SEQ ID NO: 39 - protein, 20 aa, Artificial Sequence
  Synthetic peptide
  MISC_FEATURE (1)..(1): N-terminal acetylation
  MISC_FEATURE (20)..(20): C-terminal amidation
TGHVSAGWYDYNFDHYRDFT

SEQ ID NO: 40 - protein, 20 aa, Artificial Sequence
  Synthetic peptide
  MISC_FEATURE (1)..(1): N-terminal acetylation
  MISC_FEATURE (20)..(20): C-terminal amidation
TGHVSAGWYDYNFDHYREDT

SEQ ID NO: 41 - protein, 20 aa, Artificial Sequence
  Synthetic peptide
  MISC_FEATURE (1)..(1): N-terminal acetylation
  MISC_FEATURE (20)..(20): C-terminal amidation
TGHVSAGWYDYNFDHYREFD

SEQ ID NO: 42 - protein, 20 aa, Artificial Sequence
  Synthetic peptide
  MISC_FEATURE (1)..(1): N-terminal acetylation
  MISC_FEATURE (20)..(20): C-terminal amidation
GGHVSAGWYDYNFDHYREFT

SEQ ID NO: 43 - protein, 20 aa, Artificial Sequence
  Synthetic peptide
  MISC_FEATURE (1)..(1): N-terminal acetylation
  MISC_FEATURE (20)..(20): C-terminal amidation
TGGVSAGWYDYNFDHYREFT

SEQ ID NO: 44 - protein, 20 aa, Artificial Sequence
  Synthetic peptide
  MISC_FEATURE (1)..(1): N-terminal acetylation
  MISC_FEATURE (20)..(20): C-terminal amidation
TGHGSAGWYDYNFDHYREFT

SEQ ID NO: 45 - protein, 20 aa, Artificial Sequence
  Synthetic peptide
  MISC_FEATURE (1)..(1): N-terminal acetylation
  MISC_FEATURE (20)..(20): C-terminal amidation
TGHVGAGWYDYNFDHYREFT

SEQ ID NO: 46 - protein, 20 aa, Artificial Sequence
  Synthetic peptide
  MISC_FEATURE (1)..(1): N-terminal acetylation
  MISC_FEATURE (20)..(20): C-terminal amidation
TGHVSGGWYDYNFDHYREFT

SEQ ID NO: 47 - protein, 20 aa, Artificial Sequence
  Synthetic peptide
  MISC_FEATURE (1)..(1): N-terminal acetylation
  MISC_FEATURE (20)..(20): C-terminal amidation
TGHVSAGGYDYNFDHYREFT

SEQ ID NO: 48 - protein, 20 aa, Artificial Sequence
  Synthetic peptide
  MISC_FEATURE (1)..(1): N-terminal acetylation
  MISC_FEATURE (20)..(20): C-terminal amidation
TGHVSAGWGDYNFDHYREFT

SEQ ID NO: 49 - protein, 20 aa, Artificial Sequence
  Synthetic peptide
  MISC_FEATURE (1)..(1): N-terminal acetylation
  MISC_FEATURE (20)..(20): C-terminal amidation
TGHVSAGWYGYNFDHYREFT

SEQ ID NO: 50 - protein, 20 aa, Artificial Sequence
  Synthetic peptide
  MISC_FEATURE (1)..(1): N-terminal acetylation
  MISC_FEATURE (20)..(20): C-terminal amidation
TGHVSAGWYDGNFDHYREFT

SEQ ID NO: 51 - protein, 20 aa, Artificial Sequence
  Synthetic peptide
  MISC_FEATURE (1)..(1): N-terminal acetylation
  MISC_FEATURE (20)..(20): C-terminal amidation
TGHVSAGWYDYGFDHYREFT

SEQ ID NO: 52 - protein, 20 aa, Artificial Sequence
  Synthetic peptide
  MISC_FEATURE (1)..(1): N-terminal acetylation
  MISC_FEATURE (20)..(20): C-terminal amidation
TGHVSAGWYDYNGDHYREFT

SEQ ID NO: 53 - protein, 20 aa, Artificial Sequence
  Synthetic peptide
  MISC_FEATURE (1)..(1): N-terminal acetylation
  MISC_FEATURE (20)..(20): C-terminal amidation
TGHVSAGWYDYNFGHYREFT

SEQ ID NO: 54 - protein, 20 aa, Artificial Sequence
  Synthetic peptide
  MISC_FEATURE (1)..(1): N-terminal acetylation
  MISC_FEATURE (20)..(20): C-terminal amidation
TGHVSAGWYDYNFDGYREFT

SEQ ID NO: 55 - protein, 20 aa, Artificial Sequence
  Synthetic peptide
  MISC_FEATURE (1)..(1): N-terminal acetylation
  MISC_FEATURE (20)..(20): C-terminal amidation
TGHVSAGWYDYNFDHGREFT

SEQ ID NO: 56 - protein, 20 aa, Artificial Sequence
  Synthetic peptide
  MISC_FEATURE (1)..(1): N-terminal acetylation
  MISC_FEATURE (20)..(20): C-terminal amidation
TGHVSAGWYDYNFDHYGEFT

SEQ ID NO: 57 - protein, 20 aa, Artificial Sequence
  Synthetic peptide
  MISC_FEATURE (1)..(1): N-terminal acetylation
  MISC_FEATURE (20)..(20): C-terminal amidation
TGHVSAGWYDYNFDHYRGFT

SEQ ID NO: 58 - protein, 20 aa, Artificial Sequence
  Synthetic peptide
  MISC_FEATURE (1)..(1): N-terminal acetylation
  MISC_FEATURE (20)..(20): C-terminal amidation
TGHVSAGWYDYNFDHYREGT

SEQ ID NO: 59 - protein, 20 aa, Artificial Sequence
  Synthetic peptide
  MISC_FEATURE (1)..(1): N-terminal acetylation
  MISC_FEATURE (20)..(20): C-terminal amidation
TGHVSAGWYDYNFDHYREFG

SEQ ID NO: 60 - protein, 20 aa, Artificial Sequence
  Synthetic peptide
  MISC_FEATURE (1)..(1): N-terminal acetylation
  MISC_FEATURE (20)..(20): C-terminal amidation
LGHVSAGWYDYNFDHYREFT

SEQ ID NO: 61 - protein, 20 aa, Artificial Sequence
  Synthetic peptide
  MISC_FEATURE (1)..(1): N-terminal acetylation
  MISC_FEATURE (20)..(20): C-terminal amidation
TLHVSAGWYDYNFDHYREFT

SEQ ID NO: 62 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYDYNFDHYREFT

SEQ ID NO: 63 - protein, 20 aa, Artificial Sequence
  Synthetic peptide
  MISC_FEATURE (1)..(1): N-terminal acetylation
  MISC_FEATURE (20)..(20): C-terminal amidation
TGHLSAGWYDYNFDHYREFT

SEQ ID NO: 64 - protein, 20 aa, Artificial Sequence
  Synthetic peptide
  MISC_FEATURE (1)..(1): N-terminal acetylation
  MISC_FEATURE (20)..(20): C-terminal amidation
TGHVLAGWYDYNFDHYREFT

SEQ ID NO: 65 - protein, 20 aa, Artificial Sequence
  Synthetic peptide
  MISC_FEATURE (1)..(1): N-terminal acetylation
  MISC_FEATURE (20)..(20): C-terminal amidation
TGHVSLGWYDYNFDHYREFT

SEQ ID NO: 66 - protein, 20 aa, Artificial Sequence
  Synthetic peptide
  MISC_FEATURE (1)..(1): N-terminal acetylation
  MISC_FEATURE (20)..(20): C-terminal amidation
TGHVSALWYDYNFDHYREFT

SEQ ID NO: 67 - protein, 20 aa, Artificial Sequence
  Synthetic peptide
  MISC_FEATURE (1)..(1): N-terminal acetylation
  MISC_FEATURE (20)..(20): C-terminal amidation
TGHVSAGLYDYNFDHYREFT

SEQ ID NO: 68 - protein, 20 aa, Artificial Sequence
  Synthetic peptide
  MISC_FEATURE (1)..(1): N-terminal acetylation
  MISC_FEATURE (20)..(20): C-terminal amidation
TGHVSAGWLDYNFDHYREFT

SEQ ID NO: 69 - protein, 20 aa, Artificial Sequence
  Synthetic peptide
  MISC_FEATURE (1)..(1): N-terminal acetylation
  MISC_FEATURE (20)..(20): C-terminal amidation
TGHVSAGWYLYNFDHYREFT

SEQ ID NO: 70 - protein, 20 aa, Artificial Sequence
  Synthetic peptide
  MISC_FEATURE (1)..(1): N-terminal acetylation
  MISC_FEATURE (20)..(20): C-terminal amidation
TGHVSAGWYDLNFDHYREFT

SEQ ID NO: 71 - protein, 20 aa, Artificial Sequence
  Synthetic peptide
  MISC_FEATURE (1)..(1): N-terminal acetylation
  MISC_FEATURE (20)..(20): C-terminal amidation
TGHVSAGWYDYLFDHYREFT

SEQ ID NO: 72 - protein, 20 aa, Artificial Sequence
  Synthetic peptide
  MISC_FEATURE (1)..(1): N-terminal acetylation
  MISC_FEATURE (20)..(20): C-terminal amidation
TGHVSAGWYDYNLDHYREFT

SEQ ID NO: 73 - protein, 20 aa, Artificial Sequence
  Synthetic peptide
  MISC_FEATURE (1)..(1): N-terminal acetylation
  MISC_FEATURE (20)..(20): C-terminal amidation
TGHVSAGWYDYNFLHYREFT

SEQ ID NO: 74 - protein, 20 aa, Artificial Sequence
  Synthetic peptide
  MISC_FEATURE (1)..(1): N-terminal acetylation
  MISC_FEATURE (20)..(20): C-terminal amidation
TGHVSAGWYDYNFDLYREFT

SEQ ID NO: 75 - protein, 20 aa, Artificial Sequence
  Synthetic peptide
  MISC_FEATURE (1)..(1): N-terminal acetylation
  MISC_FEATURE (20)..(20): C-terminal amidation
TGHVSAGWYDYNFDHLREFT

SEQ ID NO: 76 - protein, 20 aa, Artificial Sequence
  Synthetic peptide
  MISC_FEATURE (1)..(1): N-terminal acetylation
  MISC_FEATURE (20)..(20): C-terminal amidation
TGHVSAGWYDYNFDHYLEFT

SEQ ID NO: 77 - protein, 20 aa, Artificial Sequence
  Synthetic peptide
  MISC_FEATURE (1)..(1): N-terminal acetylation
  MISC_FEATURE (20)..(20): C-terminal amidation
TGHVSAGWYDYNFDHYRLFT

SEQ ID NO: 78 - protein, 20 aa, Artificial Sequence
  Synthetic peptide
  MISC_FEATURE (1)..(1): N-terminal acetylation
  MISC_FEATURE (20)..(20): C-terminal amidation
TGHVSAGWYDYNFDHYRELT

SEQ ID NO: 79 - protein, 20 aa, Artificial Sequence
  Synthetic peptide
  MISC_FEATURE (1)..(1): N-terminal acetylation
  MISC_FEATURE (20)..(20): C-terminal amidation
TGHVSAGWYDYNFDHYREFL

SEQ ID NO: 80 - protein, 20 aa, Artificial Sequence
  Synthetic peptide
  MISC_FEATURE (1)..(1): N-terminal acetylation
  MISC_FEATURE (20)..(20): C-terminal amidation
KGHVSAGWYDYNFDHYREFT

SEQ ID NO: 81 - protein, 20 aa, Artificial Sequence
  Synthetic peptide
  MISC_FEATURE (1)..(1): N-terminal acetylation
  MISC_FEATURE (20)..(20): C-terminal amidation
TKHVSAGWYDYNFDHYREFT

SEQ ID NO: 82 - protein, 20 aa, Artificial Sequence
  Synthetic peptide
  MISC_FEATURE (1)..(1): N-terminal acetylation
  MISC_FEATURE (20)..(20): C-terminal amidation
TGKVSAGWYDYNFDHYREFT

SEQ ID NO: 83 - protein, 20 aa, Artificial Sequence
  Synthetic peptide
  MISC_FEATURE (1)..(1): N-terminal acetylation
  MISC_FEATURE (20)..(20): C-terminal amidation
TGHKSAGWYDYNFDHYREFT

SEQ ID NO: 84 - protein, 20 aa, Artificial Sequence
  Synthetic peptide
  MISC_FEATURE (1)..(1): N-terminal acetylation
  MISC_FEATURE (20)..(20): C-terminal amidation
TGHVKAGWYDYNFDHYREFT

SEQ ID NO: 85 - protein, 20 aa, Artificial Sequence
  Synthetic peptide
  MISC_FEATURE (1)..(1): N-terminal acetylation
  MISC_FEATURE (20)..(20): C-terminal amidation
TGHVSKGWYDYNFDHYREFT

SEQ ID NO: 86 - protein, 20 aa, Artificial Sequence
  Synthetic peptide
  MISC_FEATURE (1)..(1): N-terminal acetylation
  MISC_FEATURE (20)..(20): C-terminal amidation
TGHVSAKWYDYNFDHYREFT

SEQ ID NO: 87 - protein, 20 aa, Artificial Sequence
  Synthetic peptide
  MISC_FEATURE (1)..(1): N-terminal acetylation
  MISC_FEATURE (20)..(20): C-terminal amidation
TGHVSAGKYDYNFDHYREFT

SEQ ID NO: 88 - protein, 20 aa, Artificial Sequence
  Synthetic peptide
  MISC_FEATURE (1)..(1): N-terminal acetylation
  MISC_FEATURE (20)..(20): C-terminal amidation
TGHVSAGWKDYNFDHYREFT

SEQ ID NO: 89 - protein, 20 aa, Artificial Sequence
  Synthetic peptide
  MISC_FEATURE (1)..(1): N-terminal acetylation
  MISC_FEATURE (20)..(20): C-terminal amidation
TGHVSAGWYKYNFDHYREFT

SEQ ID NO: 90 - protein, 20 aa, Artificial Sequence
  Synthetic peptide
  MISC_FEATURE (1)..(1): N-terminal acetylation
  MISC_FEATURE (20)..(20): C-terminal amidation
TGHVSAGWYDKNFDHYREFT

SEQ ID NO: 91 - protein, 20 aa, Artificial Sequence
  Synthetic peptide
  MISC_FEATURE (1)..(1): N-terminal acetylation
  MISC_FEATURE (20)..(20): C-terminal amidation
TGHVSAGWYDYKFDHYREFT

SEQ ID NO: 92 - protein, 20 aa, Artificial Sequence
  Synthetic peptide
  MISC_FEATURE (1)..(1): N-terminal acetylation
  MISC_FEATURE (20)..(20): C-terminal amidation
TGHVSAGWYDYNKDHYREFT

SEQ ID NO: 93 - protein, 20 aa, Artificial Sequence
  Synthetic peptide
  MISC_FEATURE (1)..(1): N-terminal acetylation
  MISC_FEATURE (20)..(20): C-terminal amidation
TGHVSAGWYDYNFKHYREFT

SEQ ID NO: 94 - protein, 20 aa, Artificial Sequence
  Synthetic peptide
  MISC_FEATURE (1)..(1): N-terminal acetylation
  MISC_FEATURE (20)..(20): C-terminal amidation
TGHVSAGWYDYNFDKYREFT

SEQ ID NO: 95 - protein, 20 aa, Artificial Sequence
  Synthetic peptide
  MISC_FEATURE (1)..(1): N-terminal acetylation
  MISC_FEATURE (20)..(20): C-terminal amidation
TGHVSAGWYDYNFDHKREFT

SEQ ID NO: 96 - protein, 20 aa, Artificial Sequence
  Synthetic peptide
  MISC_FEATURE (1)..(1): N-terminal acetylation
  MISC_FEATURE (20)..(20): C-terminal amidation
TGHVSAGWYDYNFDHYKEFT

SEQ ID NO: 97 - protein, 20 aa, Artificial Sequence
  Synthetic peptide
  MISC_FEATURE (1)..(1): N-terminal acetylation
  MISC_FEATURE (20)..(20): C-terminal amidation
TGHVSAGWYDYNFDHYRKFT

SEQ ID NO: 98 - protein, 20 aa, Artificial Sequence
  Synthetic peptide
  MISC_FEATURE (1)..(1): N-terminal acetylation
  MISC_FEATURE (20)..(20): C-terminal amidation
TGHVSAGWYDYNFDHYREKT

SEQ ID NO: 99 - protein, 20 aa, Artificial Sequence
  Synthetic peptide
  MISC_FEATURE (1)..(1): N-terminal acetylation
  MISC_FEATURE (20)..(20): C-terminal amidation
TGHVSAGWYDYNFDHYREFK

SEQ ID NO: 100 - protein, 20 aa, Artificial Sequence
  Synthetic peptide
  MISC_FEATURE (1)..(1): N-terminal acetylation
  MISC_FEATURE (20)..(20): C-terminal amidation
FGHVSAGWYDYNFDHYREFT

SEQ ID NO: 101 - protein, 20 aa, Artificial Sequence
  Synthetic peptide
  MISC_FEATURE (1)..(1): N-terminal acetylation
  MISC_FEATURE (20)..(20): C-terminal amidation
TFHVSAGWYDYNFDHYREFT

SEQ ID NO: 102 - protein, 20 aa, Artificial Sequence
  Synthetic peptide
  MISC_FEATURE (1)..(1): N-terminal acetylation
  MISC_FEATURE (20)..(20): C-terminal amidation
TGFVSAGWYDYNFDHYREFT

SEQ ID NO: 103 - protein, 20 aa, Artificial Sequence
  Synthetic peptide
  MISC_FEATURE (1)..(1): N-terminal acetylation
  MISC_FEATURE (20)..(20): C-terminal amidation
TGHFSAGWYDYNFDHYREFT

SEQ ID NO: 104 - protein, 20 aa, Artificial Sequence
  Synthetic peptide
  MISC_FEATURE (1)..(1): N-terminal acetylation
  MISC_FEATURE (20)..(20): C-terminal amidation
TGHVFAGWYDYNFDHYREFT

SEQ ID NO: 105 - protein, 20 aa, Artificial Sequence
  Synthetic peptide
  MISC_FEATURE (1)..(1): N-terminal acetylation
  MISC_FEATURE (20)..(20): C-terminal amidation
TGHVSFGWYDYNFDHYREFT

SEQ ID NO: 106 - protein, 20 aa, Artificial Sequence
  Synthetic peptide
  MISC_FEATURE (1)..(1): N-terminal acetylation
  MISC_FEATURE (20)..(20): C-terminal amidation
TGHVSAFWYDYNFDHYREFT

SEQ ID NO: 107 - protein, 20 aa, Artificial Sequence
  Synthetic peptide
  MISC_FEATURE (1)..(1): N-terminal acetylation
  MISC_FEATURE (20)..(20): C-terminal amidation
TGHVSAGFYDYNFDHYREFT

SEQ ID NO: 108 - protein, 20 aa, Artificial Sequence
  Synthetic peptide
  MISC_FEATURE (1)..(1): N-terminal acetylation
  MISC_FEATURE (20)..(20): C-terminal amidation
TGHVSAGWFDYNFDHYREFT

SEQ ID NO: 109 - protein, 20 aa, Artificial Sequence
  Synthetic peptide
  MISC_FEATURE (1)..(1): N-terminal acetylation
  MISC_FEATURE (20)..(20): C-terminal amidation
TGHVSAGWYFYNFDHYREFT

SEQ ID NO: 110 - protein, 20 aa, Artificial Sequence
  Synthetic peptide
  MISC_FEATURE (1)..(1): N-terminal acetylation
  MISC_FEATURE (20)..(20): C-terminal amidation
TGHVSAGWYDFNFDHYREFT

SEQ ID NO: 111 - protein, 20 aa, Artificial Sequence
  Synthetic peptide
  MISC_FEATURE (1)..(1): N-terminal acetylation
  MISC_FEATURE (20)..(20): C-terminal amidation
TGHVSAGWYDYFFDHYREFT

SEQ ID NO: 112 - protein, 20 aa, Artificial Sequence
  Synthetic peptide
  MISC_FEATURE (1)..(1): N-terminal acetylation
  MISC_FEATURE (20)..(20): C-terminal amidation
TGHVSAGWYDYNFFHYREFT

SEQ ID NO: 113 - protein, 20 aa, Artificial Sequence
  Synthetic peptide
  MISC_FEATURE (1)..(1): N-terminal acetylation
  MISC_FEATURE (20)..(20): C-terminal amidation
TGHVSAGWYDYNFDFYREFT

SEQ ID NO: 114 - protein, 20 aa, Artificial Sequence
  Synthetic peptide
  MISC_FEATURE (1)..(1): N-terminal acetylation
  MISC_FEATURE (20)..(20): C-terminal amidation
TGHVSAGWYDYNFDHFREFT

SEQ ID NO: 115 - protein, 20 aa, Artificial Sequence
  Synthetic peptide
  MISC_FEATURE (1)..(1): N-terminal acetylation
  MISC_FEATURE (20)..(20): C-terminal amidation
TGHVSAGWYDYNFDHYFEFT

SEQ ID NO: 116 - protein, 20 aa, Artificial Sequence
  Synthetic peptide
  MISC_FEATURE (1)..(1): N-terminal acetylation
  MISC_FEATURE (20)..(20): C-terminal amidation
TGHVSAGWYDYNFDHYRFFT

SEQ ID NO: 117 - protein, 20 aa, Artificial Sequence
  Synthetic peptide
  MISC_FEATURE (1)..(1): N-terminal acetylation
  MISC_FEATURE (20)..(20): C-terminal amidation
TGHVSAGWYDYNFDHYREFF

SEQ ID NO: 118 - protein, 20 aa, Artificial Sequence
  Synthetic peptide
  MISC_FEATURE (1)..(1): N-terminal acetylation
  MISC_FEATURE (20)..(20): C-terminal amidation
PGHVSAGWYDYNFDHYREFT

SEQ ID NO: 119 - protein, 20 aa, Artificial Sequence
  Synthetic peptide
  MISC_FEATURE (1)..(1): N-terminal acetylation
  MISC_FEATURE (20)..(20): C-terminal amidation
TPHVSAGWYDYNFDHYREFT

SEQ ID NO: 120 - protein, 20 aa, Artificial Sequence
  Synthetic peptide
  MISC_FEATURE (1)..(1): N-terminal acetylation
  MISC_FEATURE (20)..(20): C-terminal amidation
TGPVSAGWYDYNFDHYREFT

SEQ ID NO: 121 - protein, 20 aa, Artificial Sequence
  Synthetic peptide
  MISC_FEATURE (1)..(1): N-terminal acetylation
  MISC_FEATURE (20)..(20): C-terminal amidation
TGHPSAGWYDYNFDHYREFT

SEQ ID NO: 122 - protein, 20 aa, Artificial Sequence
  Synthetic peptide
  MISC_FEATURE (1)..(1): N-terminal acetylation
  MISC_FEATURE (20)..(20): C-terminal amidation
TGHVPAGWYDYNFDHYREFT

SEQ ID NO: 123 - protein, 20 aa, Artificial Sequence
  Synthetic peptide
  MISC_FEATURE (1)..(1): N-terminal acetylation
  MISC_FEATURE (20)..(20): C-terminal amidation
TGHVSPGWYDYNFDHYREFT

SEQ ID NO: 124 - protein, 20 aa, Artificial Sequence
  Synthetic peptide
  MISC_FEATURE (1)..(1): N-terminal acetylation
  MISC_FEATURE (20)..(20): C-terminal amidation
TGHVSAPWYDYNFDHYREFT

SEQ ID NO: 125 - protein, 20 aa, Artificial Sequence
  Synthetic peptide
  MISC_FEATURE (1)..(1): N-terminal acetylation
  MISC_FEATURE (20)..(20): C-terminal amidation
TGHVSAGPYDYNFDHYREFT

SEQ ID NO: 126 - protein, 20 aa, Artificial Sequence
  Synthetic peptide
  MISC_FEATURE (1)..(1): N-terminal acetylation
  MISC_FEATURE (20)..(20): C-terminal amidation
TGHVSAGWPDYNFDHYREFT

SEQ ID NO: 127 - protein, 20 aa, Artificial Sequence
  Synthetic peptide
  MISC_FEATURE (1)..(1): N-terminal acetylation
  MISC_FEATURE (20)..(20): C-terminal amidation
TGHVSAGWYPYNFDHYREFT

SEQ ID NO: 128 - protein, 20 aa, Artificial Sequence
  Synthetic peptide
  MISC_FEATURE (1)..(1): N-terminal acetylation
  MISC_FEATURE (20)..(20): C-terminal amidation
TGHVSAGWYDPNFDHYREFT

SEQ ID NO: 129 - protein, 20 aa, Artificial Sequence
  Synthetic peptide
  MISC_FEATURE (1)..(1): N-terminal acetylation
  MISC_FEATURE (20)..(20): C-terminal amidation
TGHVSAGWYDYPFDHYREFT

SEQ ID NO: 130 - protein, 20 aa, Artificial Sequence
  Synthetic peptide
  MISC_FEATURE (1)..(1): N-terminal acetylation
  MISC_FEATURE (20)..(20): C-terminal amidation
TGHVSAGWYDYNPDHYREFT

SEQ ID NO: 131 - protein, 20 aa, Artificial Sequence
  Synthetic peptide
  MISC_FEATURE (1)..(1): N-terminal acetylation
  MISC_FEATURE (20)..(20): C-terminal amidation
TGHVSAGWYDYNFPHYREFT

SEQ ID NO: 132 - protein, 20 aa, Artificial Sequence
  Synthetic peptide
  MISC_FEATURE (1)..(1): N-terminal acetylation
  MISC_FEATURE (20)..(20): C-terminal amidation
TGHVSAGWYDYNFDPYREFT

SEQ ID NO: 133 - protein, 20 aa, Artificial Sequence
  Synthetic peptide
  MISC_FEATURE (1)..(1): N-terminal acetylation
  MISC_FEATURE (20)..(20): C-terminal amidation
TGHVSAGWYDYNFDHPREFT

SEQ ID NO: 134 - protein, 20 aa, Artificial Sequence
  Synthetic peptide
  MISC_FEATURE (1)..(1): N-terminal acetylation
  MISC_FEATURE (20)..(20): C-terminal amidation
TGHVSAGWYDYNFDHYPEFT

SEQ ID NO: 135 - protein, 20 aa, Artificial Sequence
  Synthetic peptide
  MISC_FEATURE (1)..(1): N-terminal acetylation
  MISC_FEATURE (20)..(20): C-terminal amidation
TGHVSAGWYDYNFDHYRPFT

SEQ ID NO: 136 - protein, 20 aa, Artificial Sequence
  Synthetic peptide
  MISC_FEATURE (1)..(1): N-terminal acetylation
  MISC_FEATURE (20)..(20): C-terminal amidation
TGHVSAGWYDYNFDHYREPT

SEQ ID NO: 137 - protein, 20 aa, Artificial Sequence
  Synthetic peptide
  MISC_FEATURE (1)..(1): N-terminal acetylation
  MISC_FEATURE (20)..(20): C-terminal amidation
TGHVSAGWYDYNFDHYREFP

SEQ ID NO: 138 - protein, 20 aa, Artificial Sequence
  Synthetic peptide
  MISC_FEATURE (1)..(1): N-terminal acetylation
  MISC_FEATURE (20)..(20): C-terminal amidation
SGHVSAGWYDYNFDHYREFT

SEQ ID NO: 139 - protein, 20 aa, Artificial Sequence
  Synthetic peptide
  MISC_FEATURE (1)..(1): N-terminal acetylation
  MISC_FEATURE (20)..(20): C-terminal amidation
TSHVSAGWYDYNFDHYREFT

SEQ ID NO: 140 - protein, 20 aa, Artificial Sequence
  Synthetic peptide
  MISC_FEATURE (1)..(1): N-terminal acetylation
  MISC_FEATURE (20)..(20): C-terminal amidation
TGSVSAGWYDYNFDHYREFT

SEQ ID NO: 141 - protein, 20 aa, Artificial Sequence
  Synthetic peptide
  MISC_FEATURE (1)..(1): N-terminal acetylation
  MISC_FEATURE (20)..(20): C-terminal amidation
TGHSSAGWYDYNFDHYREFT

SEQ ID NO: 142 - protein, 20 aa, Artificial Sequence
  Synthetic peptide
  MISC_FEATURE (1)..(1): N-terminal acetylation
  MISC_FEATURE (20)..(20): C-terminal amidation
TGHVSSGWYDYNFDHYREFT

SEQ ID NO: 143 - protein, 20 aa, Artificial Sequence
  Synthetic peptide
  MISC_FEATURE (1)..(1): N-terminal acetylation
  MISC_FEATURE (20)..(20): C-terminal amidation
TGHVSASWYDYNFDHYREFT

SEQ ID NO: 144 - protein, 20 aa, Artificial Sequence
  Synthetic peptide
  MISC_FEATURE (1)..(1): N-terminal acetylation
  MISC_FEATURE (20)..(20): C-terminal amidation
TGHVSAGSYDYNFDHYREFT

SEQ ID NO: 145 - protein, 20 aa, Artificial Sequence
  Synthetic peptide
  MISC_FEATURE (1)..(1): N-terminal acetylation
  MISC_FEATURE (20)..(20): C-terminal amidation
TGHVSAGWSDYNFDHYREFT

SEQ ID NO: 146 - protein, 20 aa, Artificial Sequence
  Synthetic peptide
  MISC_FEATURE (1)..(1): N-terminal acetylation
  MISC_FEATURE (20)..(20): C-terminal amidation
TGHVSAGWYSYNFDHYREFT

SEQ ID NO: 147 - protein, 20 aa, Artificial Sequence
  Synthetic peptide
  MISC_FEATURE (1)..(1): N-terminal acetylation
  MISC_FEATURE (20)..(20): C-terminal amidation
TGHVSAGWYDSNFDHYREFT

SEQ ID NO: 148 - protein, 20 aa, Artificial Sequence
  Synthetic peptide
  MISC_FEATURE (1)..(1): N-terminal acetylation
  MISC_FEATURE (20)..(20): C-terminal amidation
TGHVSAGWYDYSFDHYREFT

SEQ ID NO: 149 - protein, 20 aa, Artificial Sequence
  Synthetic peptide
  MISC_FEATURE (1)..(1): N-terminal acetylation
  MISC_FEATURE (20)..(20): C-terminal amidation
TGHVSAGWYDYNSDHYREFT

SEQ ID NO: 150 - protein, 20 aa, Artificial Sequence
  Synthetic peptide
  MISC_FEATURE (1)..(1): N-terminal acetylation
  MISC_FEATURE (20)..(20): C-terminal amidation
TGHVSAGWYDYNFSHYREFT

SEQ ID NO: 151 - protein, 20 aa, Artificial Sequence
  Synthetic peptide
  MISC_FEATURE (1)..(1): N-terminal acetylation
  MISC_FEATURE (20)..(20): C-terminal amidation
TGHVSAGWYDYNFDSYREFT

SEQ ID NO: 152 - protein, 20 aa, Artificial Sequence
  Synthetic peptide
  MISC_FEATURE (1)..(1): N-terminal acetylation
  MISC_FEATURE (20)..(20): C-terminal amidation
TGHVSAGWYDYNFDHSREFT

SEQ ID NO: 153 - protein, 20 aa, Artificial Sequence
  Synthetic peptide
  MISC_FEATURE (1)..(1): N-terminal acetylation
  MISC_FEATURE (20)..(20): C-terminal amidation
TGHVSAGWYDYNFDHYSEFT

SEQ ID NO: 154 - protein, 20 aa, Artificial Sequence
  Synthetic peptide
  MISC_FEATURE (1)..(1): N-terminal acetylation
  MISC_FEATURE (20)..(20): C-terminal amidation
TGHVSAGWYDYNFDHYRSFT

SEQ ID NO: 155 - protein, 20 aa, Artificial Sequence
  Synthetic peptide
  MISC_FEATURE (1)..(1): N-terminal acetylation
  MISC_FEATURE (20)..(20): C-terminal amidation
TGHVSAGWYDYNFDHYREST

SEQ ID NO: 156 - protein, 20 aa, Artificial Sequence
  Synthetic peptide
  MISC_FEATURE (1)..(1): N-terminal acetylation
  MISC_FEATURE (20)..(20): C-terminal amidation
TGHVSAGWYDYNFDHYREFS

SEQ ID NO: 157 - protein, 17 aa, Artificial Sequence
  Synthetic peptide
  MISC_FEATURE (1)..(1): N-terminal acetylation
  MISC_FEATURE (17)..(17): C-terminal amidation
TGHVSAGWYDYNFDHYR

SEQ ID NO: 158 - protein, 14 aa, Artificial Sequence
  Synthetic peptide
  MISC_FEATURE (1)..(1): N-terminal acetylation
  MISC_FEATURE (14)..(14): C-terminal amidation
TGHVSAGWYDYNFD

SEQ ID NO: 159 - protein, 11 aa, Artificial Sequence
  Synthetic peptide
  MISC_FEATURE (1)..(1): N-terminal acetylation
  MISC_FEATURE (11)..(11): C-terminal amidation
TGHVSAGWYDY

SEQ ID NO: 160 - protein, 17 aa, Artificial Sequence
  Synthetic peptide
  MISC_FEATURE (1)..(1): N-terminal acetylation
  MISC_FEATURE (17)..(17): C-terminal amidation
VSAGWYDYNFDHYREFT

SEQ ID NO: 161 - protein, 14 aa, Artificial Sequence
  Synthetic peptide
  MISC_FEATURE (1)..(1): N-terminal acetylation
  MISC_FEATURE (14)..(14): C-terminal amidation
GWYDYNFDHYREFT

SEQ ID NO: 162 - protein, 11 aa, Artificial Sequence
  Synthetic peptide
  MISC_FEATURE (1)..(1): N-terminal acetylation
  MISC_FEATURE (11)..(11): C-terminal amidation
DYNFDHYREFT

SEQ ID NO: 163 - protein, 14 aa, Artificial Sequence
  Synthetic peptide
  MISC_FEATURE (1)..(1): N-terminal acetylation
  MISC_FEATURE (14)..(14): C-terminal amidation
VSAGWYDYNFDHYR

SEQ ID NO: 164 - protein, 8 aa, Artificial Sequence
  Synthetic peptide
  MISC_FEATURE (1)..(1): N-terminal acetylation
  MISC_FEATURE (8)..(8): C-terminal amidation
GWYDYNFD

SEQ ID NO: 165 - protein, 20 aa, Artificial Sequence
  Synthetic peptide
  MISC_FEATURE (1)..(1): N-terminal acetylation
  MISC_FEATURE (20)..(20): C-terminal amidation
GGHVSAGWYDYNKDHYREFT

SEQ ID NO: 166 - protein, 19 aa, Artificial Sequence
  Synthetic peptide
  MISC_FEATURE (1)..(1): N-terminal acetylation
  MISC_FEATURE (19)..(19): C-terminal amidation
TGHVSAGWYDYNFDHYREF

SEQ ID NO: 167 - protein, 18 aa, Artificial Sequence
  Synthetic peptide
  MISC_FEATURE (1)..(1): N-terminal acetylation
  MISC_FEATURE (18)..(18): C-terminal amidation
TGHVSAGWYDYNFDHYRE

SEQ ID NO: 168 - protein, 20 aa, Artificial Sequence
  Synthetic peptide
  MISC_FEATURE (1)..(1): N-terminal acetylation
  MISC_FEATURE (20)..(20): C-terminal amidation
TAHVSAGWYDYNFDDYREFT

SEQ ID NO: 169 - protein, 20 aa, Artificial Sequence
  Synthetic peptide
  MISC_FEATURE (1)..(1): N-terminal acetylation
  MISC_FEATURE (20)..(20): C-terminal amidation
TAHVSAGWYDYNFDLYREFT

SEQ ID NO: 170 - protein, 20 aa, Artificial Sequence
  Synthetic peptide
  MISC_FEATURE (1)..(1): N-terminal acetylation
  MISC_FEATURE (20)..(20): C-terminal amidation
GAHVSAGWYDYNFDHYREFT

SEQ ID NO: 171 - protein, 20 aa, Artificial Sequence
  Synthetic peptide
  MISC_FEATURE (1)..(1): N-terminal acetylation
  MISC_FEATURE (20)..(20): C-terminal amidation
GGHVSAGWYDYNFDLYREFT

SEQ ID NO: 172 - protein, 20 aa, Artificial Sequence
  Synthetic peptide
  MISC_FEATURE (1)..(1): N-terminal acetylation
  MISC_FEATURE (20)..(20): C-terminal amidation
GAHVSAGWYDYNFDLYREFT

SEQ ID NO: 173 - protein, 20 aa, Artificial Sequence
  Synthetic peptide
  MISC_FEATURE (1)..(1): N-terminal acetylation
  MISC_FEATURE (20)..(20): C-terminal amidation
GGHVSAGWYDYNADHYREFT

SEQ ID NO: 174 - protein, 20 aa, Artificial Sequence
  Synthetic peptide
  MISC_FEATURE (1)..(1): N-terminal acetylation
  MISC_FEATURE (4)..(4): D-Ser
  MISC_FEATURE (20)..(20): C-terminal amidation
TGHVSAGWYDYNFDHYREFT

SEQ ID NO: 175 - protein, 20 aa, Artificial Sequence
  Synthetic peptide
  MISC_FEATURE (1)..(1): N-terminal acetylation
  MISC_FEATURE (5)..(5): D-Ala
  MISC_FEATURE (20)..(20): C-terminal amidation
TGHVSAGWYDYNFDHYREFT

SEQ ID NO: 176 - protein, 20 aa, Artificial Sequence
  Synthetic peptide
  MISC_FEATURE (1)..(1): N-terminal acetylation
  MISC_FEATURE (7)..(7): D-Ala
  MISC_FEATURE (20)..(20): C-terminal amidation
TGHVSAAWYDYNFDHYREFT

SEQ ID NO: 177 - protein, 20 aa, Artificial Sequence
  Synthetic peptide
  MISC_FEATURE (1)..(1): N-terminal acetylation
  MISC_FEATURE (8)..(8): D-Trp
  MISC_FEATURE (20)..(20): C-terminal amidation
TGHVSAGWYDYNFDHYREFT

SEQ ID NO: 178 - protein, 20 aa, Artificial Sequence
  Synthetic peptide
  MISC_FEATURE (1)..(1): N-terminal acetylation
  MISC_FEATURE (20)..(20): C-terminal amidation
TGHVEVGWYDYNFDHYREFT

SEQ ID NO: 179 - protein, 21 aa, Artificial Sequence
  Synthetic peptide
  MISC_FEATURE (1)..(1): N-terminal Biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XTGHVSAGWYDYNADHYREFT

SEQ ID NO: 180 - protein, 21 aa, Artificial Sequence
  Synthetic peptide
  MISC_FEATURE (1)..(1): N-terminal Biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XTGLVSAGWYDYNFDHYREFT

SEQ ID NO: 181 - protein, 21 aa, Artificial Sequence
  Synthetic peptide
  MISC_FEATURE (1)..(1): N-terminal Biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XTPHVSAGWYDYNFDHYREFT

SEQ ID NO: 182 - protein, 20 aa, Artificial Sequence
  Synthetic peptide
  MISC_FEATURE (1)..(1): N-terminal Biotinyl
  MISC_FEATURE (1)..(1): Xaa is (13-Amino-4,7,10-trioxa-tridecyl)-succinamic acid (ttds)
  MISC_FEATURE (20)..(20): C-terminal amidation
XTGHVSAGWYDYNFDHYREF

SEQ ID NO: 183 - protein, 21 aa, Artificial Sequence
  Synthetic peptide
  MISC_FEATURE (1)..(1): N-terminal acetylation
  MISC_FEATURE (21)..(21): MODIFIED CYS
  MISC_FEATURE (21)..(21): C-terminal amidation
TGLVSAGWYDYNFDHYREFTC

SEQ ID NO: 184 - protein, 21 aa, Artificial Sequence
  Synthetic peptide
  MISC_FEATURE (1)..(1): N-terminal acetylation
  MISC_FEATURE (1)..(1): Covalently bound to 400Mal-PEG
  MISC_FEATURE (21)..(21): C-terminal amidation
CTGLVSAGWYDYNFDHYREFT

SEQ ID NO: 185 - protein, 20 aa, Artificial Sequence
  Synthetic peptide
  MISC_FEATURE (1)..(1): N-terminal acetylation
  MISC_FEATURE (4)..(4): Xaa is tert-Leu (Tle)
  MISC_FEATURE (20)..(20): C-terminal amidation
TGLXSAGWYDYNFDHYREFT

SEQ ID NO: 186 - protein, 20 aa, Artificial Sequence
  Synthetic peptide
  MISC_FEATURE (1)..(1): N-terminal acetylation
  MISC_FEATURE (5)..(5): Xaa is (S)-Diaminopropionic acid (Dap)
  MISC_FEATURE (20)..(20): C-terminal amidation
TGLVXAGWYDYNFDHYREFT

SEQ ID NO: 187 - protein, 20 aa, Artificial Sequence
  Synthetic peptide
  MISC_FEATURE (1)..(1): N-terminal acetylation
  MISC_FEATURE (6)..(6): Xaa is 2-amino-isobutyric acid (Aib)
  MISC_FEATURE (20)..(20): C-terminal amidation
TGLVSXGWYDYNFDHYREFT

SEQ ID NO: 188 - protein, 20 aa, Artificial Sequence
  Synthetic peptide
  MISC_FEATURE (1)..(1): N-terminal acetylation
  MISC_FEATURE (6)..(6): Xaa is tert-Leu (Tle)
  MISC_FEATURE (20)..(20): C-terminal amidation
TGLVSXGWYDYNFDHYREFT

SEQ ID NO: 189 - protein, 20 aa, Artificial Sequence
  Synthetic peptide
  MISC_FEATURE (1)..(1): N-terminal acetylation
  MISC_FEATURE (7)..(7): Xaa is 2-amino-isobutyric acid (Aib)
  MISC_FEATURE (20)..(20): C-terminal amidation
TGLVSAXWYDYNFDHYREFT

SEQ ID NO: 190 - protein, 20 aa, Artificial Sequence
  Synthetic peptide
  MISC_FEATURE (1)..(1): N-terminal acetylation
  MISC_FEATURE (7)..(7): Xaa is N-methyl-Gly (Nmg)
  MISC_FEATURE (20)..(20): C-terminal amidation
TGLVSAXWYDYNFDHYREFT

SEQ ID NO: 191 - protein, 20 aa, Artificial Sequence
  Synthetic peptide
  MISC_FEATURE (1)..(1): N-terminal acetylation
  MISC_FEATURE (8)..(8): Xaa is L-3-Benzothienylalanine (Bta)
  MISC_FEATURE (20)..(20): C-terminal amidation
TGLVSAGXYDYNFDHYREFT

SEQ ID NO: 192 - protein, 20 aa, Artificial Sequence
  Synthetic peptide
  MISC_FEATURE (1)..(1): N-terminal acetylation
  MISC_FEATURE (8)..(8): Xaa is 1-naphtylalanine (1Ni)
  MISC_FEATURE (20)..(20): C-terminal amidation
TGLVSAGXYDYNFDHYREFT

SEQ ID NO: 193 - protein, 20 aa, Artificial Sequence
  Synthetic peptide
  MISC_FEATURE (1)..(1): N-terminal acetylation
  MISC_FEATURE (8)..(8): Xaa is 2-naphthylalanine (2Ni)
  MISC_FEATURE (20)..(20): C-terminal amidation
TGLVSAGXYDYNFDHYREFT

SEQ ID NO: 194 - protein, 20 aa, Artificial Sequence
  Synthetic peptide
  MISC_FEATURE (1)..(1): N-terminal acetylation
  MISC_FEATURE (9)..(9): D-Tyr
  MISC_FEATURE (20)..(20): C-terminal amidation
TGLVSAGWYDYNFDHYREFT

SEQ ID NO: 195 - protein, 20 aa, Artificial Sequence
  Synthetic peptide
  MISC_FEATURE (1)..(1): N-terminal acetylation
  MISC_FEATURE (10)..(10): D-Asp
  MISC_FEATURE (20)..(20): C-terminal amidation
TGLVSAGWYDYNFDHYREFT

SEQ ID NO: 196 - protein, 20 aa, Artificial Sequence
  Synthetic peptide
  MISC_FEATURE (1)..(1): N-terminal acetylation
  MISC_FEATURE (11)..(11): D-Tyr
  MISC_FEATURE (20)..(20): C-terminal amidation
TGLVSAGWYDYNFDHYREFT

SEQ ID NO: 197 - protein, 20 aa, Artificial Sequence
  Synthetic peptide
  MISC_FEATURE (1)..(1): N-terminal acetylation
  MISC_FEATURE (12)..(12): Xaa is Asn
  MISC_FEATURE (20)..(20): C-terminal amidation
TGLVSAGWYDYNFDHYREFT

SEQ ID NO: 198 - protein, 20 aa, Artificial Sequence
  Synthetic peptide
  MISC_FEATURE (1)..(1): N-terminal acetylation
  MISC_FEATURE (13)..(13): D-Ala
  MISC_FEATURE (20)..(20): C-terminal amidation
TGLVSAGWYDYNADHYREFT

SEQ ID NO: 199 - protein, 22 aa, Artificial Sequence
  Synthetic peptide
  MISC_FEATURE (1)..(1): N-terminal acetylation
  MISC_FEATURE (21)..(21): Xaa is (13-Amino-4,7,10-trioxa-tridecyl)-succinamic acid (ttds)
  MISC_FEATURE (22)..(22): Covelently bound to biotin via epsilon amino group
  MISC_FEATURE (22)..(22): C-terminal amidation
TGHVSAGWYDYNFDHYREFTXK

SEQ ID NO: 200 - protein, 20 aa, Artificial Sequence
  Synthetic peptide
  MISC_FEATURE (1)..(1): N-terminal acetylation
  MISC_FEATURE (20)..(20): C-terminal amidation
EGLVSAGWYDYNFDHYREFT

SEQ ID NO: 201 - protein, 20 aa, Artificial Sequence
  Synthetic peptide
  MISC_FEATURE (1)..(1): N-terminal acetylation
  MISC_FEATURE (20)..(20): C-terminal amidation
TELVSAGWYDYNFDHYREFT

SEQ ID NO: 202 - protein, 20 aa, Artificial Sequence
  Synthetic peptide
  MISC_FEATURE (1)..(1): N-terminal acetylation
  MISC_FEATURE (20)..(20): C-terminal amidation
TGEVSAGWYDYNFDHYREFT

SEQ ID NO: 203 - protein, 20 aa, Artificial Sequence
  Synthetic peptide
  MISC_FEATURE (1)..(1): N-terminal acetylation
  MISC_FEATURE (20)..(20): C-terminal amidation
TGLESAGWYDYNFDHYREFT

SEQ ID NO: 204 - protein, 20 aa, Artificial Sequence
  Synthetic peptide
  MISC_FEATURE (1)..(1): N-terminal acetylation
  MISC_FEATURE (20)..(20): C-terminal amidation
TGLVEAGWYDYNFDHYREFT

SEQ ID NO: 205 - protein, 20 aa, Artificial Sequence
  Synthetic peptide
  MISC_FEATURE (1)..(1): N-terminal acetylation
  MISC_FEATURE (20)..(20): C-terminal amidation
TGLVSEGWYDYNFDHYREFT

SEQ ID NO: 206 - protein, 20 aa, Artificial Sequence
  Synthetic peptide
  MISC_FEATURE (1)..(1): N-terminal acetylation
  MISC_FEATURE (20)..(20): C-terminal amidation
TGLVSAEWYDYNFDHYREFT

SEQ ID NO: 207 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGEYDYNFDHYREFT

SEQ ID NO: 208 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWEDYNFDHYREFT

SEQ ID NO: 209 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYEYNFDHYREFT

SEQ ID NO: 210 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYDENFDHYREFT

SEQ ID NO: 211 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYDYEFDHYREFT

SEQ ID NO: 212 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYDYNEDHYREFT

SEQ ID NO: 213 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYDYNFEHYREFT

SEQ ID NO: 214 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYDYNFDEYREFT

SEQ ID NO: 215 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYDYNFDHEREFT

SEQ ID NO: 216 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYDYNFDHYEEFT

SEQ ID NO: 217 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYDYNFDHYREET

SEQ ID NO: 218 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYDYNFDHYREFE

SEQ ID NO: 219 - protein, 20 aa, Artificial Sequence
  Synthetic peptide
  MISC_FEATURE (1)..(1): N-terminal acetylation
  MISC_FEATURE (20)..(20): C-terminal amidation
HGLVSAGWYDYNFDHYREFT

SEQ ID NO: 220 - protein, 20 aa, Artificial Sequence
  Synthetic peptide
  MISC_FEATURE (1)..(1): N-terminal acetylation
  MISC_FEATURE (20)..(20): C-terminal amidation
THLVSAGWYDYNFDHYREFT

SEQ ID NO: 221 - protein, 20 aa, Artificial Sequence
  Synthetic peptide
  MISC_FEATURE (1)..(1): N-terminal acetylation
  MISC_FEATURE (20)..(20): C-terminal amidation
TGLHSAGWYDYNFDHYREFT

SEQ ID NO: 222 - protein, 20 aa, Artificial Sequence
  Synthetic peptide
  MISC_FEATURE (1)..(1): N-terminal acetylation
  MISC_FEATURE (20)..(20): C-terminal amidation
TGLVHAGWYDYNFDHYREFT

SEQ ID NO: 223 - protein, 20 aa, Artificial Sequence
  Synthetic peptide
  MISC_FEATURE (1)..(1): N-terminal acetylation
  MISC_FEATURE (20)..(20): C-terminal amidation
TGLVSHGWYDYNFDHYREFT

SEQ ID NO: 224 - protein, 20 aa, Artificial Sequence
  Synthetic peptide
  MISC_FEATURE (1)..(1): N-terminal acetylation
  MISC_FEATURE (20)..(20): C-terminal amidation
TGLVSAHWYDYNFDHYREFT

SEQ ID NO: 225 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGHYDYNFDHYREFT

SEQ ID NO: 226 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWHDYNFDHYREFT

SEQ ID NO: 227 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYHYNFDHYREFT

SEQ ID NO: 228 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYDHNFDHYREFT

SEQ ID NO: 229 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYDYHFDHYREFT

SEQ ID NO: 230 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYDYNHDHYREFT

SEQ ID NO: 231 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYDYNFHHYREFT

SEQ ID NO: 232 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYDYNFDHYREFT

SEQ ID NO: 233 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYDYNFDHHREFT

SEQ ID NO: 234 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYDYNFDHYHEFT

SEQ ID NO: 235 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYDYNFDHYRHFT

SEQ ID NO: 236 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYDYNFDHYREHT

SEQ ID NO: 237 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYDYNFDHYREFH

SEQ ID NO: 238 - protein, 20 aa, Artificial Sequence
  Synthetic peptide
  MISC_FEATURE (1)..(1): N-terminal acetylation
  MISC_FEATURE (20)..(20): C-terminal amidation
IGLVSAGWYDYNFDHYREFT

SEQ ID NO: 239 - protein, 20 aa, Artificial Sequence
  Synthetic peptide
  MISC_FEATURE (1)..(1): N-terminal acetylation
  MISC_FEATURE (20)..(20): C-terminal amidation
TILVSAGWYDYNFDHYREFT

SEQ ID NO: 240 - protein, 20 aa, Artificial Sequence
  Synthetic peptide
  MISC_FEATURE (1)..(1): N-terminal acetylation
  MISC_FEATURE (20)..(20): C-terminal amidation
TGIVSAGWYDYNFDHYREFT

SEQ ID NO: 241 - protein, 20 aa, Artificial Sequence
  Synthetic peptide
  MISC_FEATURE (1)..(1): N-terminal acetylation
  MISC_FEATURE (20)..(20): C-terminal amidation
TGLISAGWYDYNFDHYREFT

SEQ ID NO: 242 - protein, 20 aa, Artificial Sequence
  Synthetic peptide
  MISC_FEATURE (1)..(1): N-terminal acetylation
  MISC_FEATURE (20)..(20): C-terminal amidation
TGLVIAGWYDYNFDHYREFT

SEQ ID NO: 243 - protein, 20 aa, Artificial Sequence
  Synthetic peptide
  MISC_FEATURE (1)..(1): N-terminal acetylation
  MISC_FEATURE (20)..(20): C-terminal amidation
TGLVSIGWYDYNFDHYREFT

SEQ ID NO: 244 - protein, 20 aa, Artificial Sequence
  Synthetic peptide
  MISC_FEATURE (1)..(1): N-terminal acetylation
  MISC_FEATURE (20)..(20): C-terminal amidation
TGLVSAIWYDYNFDHYREFT

SEQ ID NO: 245 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGIYDYNFDHYREFT

SEQ ID NO: 246 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWIDYNFDHYREFT

SEQ ID NO: 247 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYIYNFDHYREFT

SEQ ID NO: 248 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYDINFDHYREFT

SEQ ID NO: 249 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYDYIFDHYREFT

SEQ ID NO: 250 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYDYNIDHYREFT

SEQ ID NO: 251 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYDYNFIHYREFT

SEQ ID NO: 252 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYDYNFDIYREFT

SEQ ID NO: 253 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYDYNFDHIREFT

SEQ ID NO: 254 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYDYNFDHYIEFT

SEQ ID NO: 255 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYDYNFDHYRIFT

SEQ ID NO: 256 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYDYNFDHYREIT

SEQ ID NO: 257 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYDYNFDHYREFI

SEQ ID NO: 258 - protein, 20 aa, Artificial Sequence
  Synthetic peptide
  MISC_FEATURE (1)..(1): N-terminal acetylation
  MISC_FEATURE (20)..(20): C-terminal amidation
MGLVSAGWYDYNFDHYREFT

SEQ ID NO: 259 - protein, 20 aa, Artificial Sequence
  Synthetic peptide
  MISC_FEATURE (1)..(1): N-terminal acetylation
  MISC_FEATURE (20)..(20): C-terminal amidation
TMLVSAGWYDYNFDHYREFT

SEQ ID NO: 260 - protein, 20 aa, Artificial Sequence
  Synthetic peptide
  MISC_FEATURE (1)..(1): N-terminal acetylation
  MISC_FEATURE (20)..(20): C-terminal amidation
TGMVSAGWYDYNFDHYREFT

SEQ ID NO: 261 - protein, 20 aa, Artificial Sequence
  Synthetic peptide
  MISC_FEATURE (1)..(1): N-terminal acetylation
  MISC_FEATURE (20)..(20): C-terminal amidation
TGLMSAGWYDYNFDHYREFT

SEQ ID NO: 262 - protein, 20 aa, Artificial Sequence
  Synthetic peptide
  MISC_FEATURE (1)..(1): N-terminal acetylation
  MISC_FEATURE (20)..(20): C-terminal amidation
TGLVMAGWYDYNFDHYREFT

SEQ ID NO: 263 - protein, 20 aa, Artificial Sequence
  Synthetic peptide
  MISC_FEATURE (1)..(1): N-terminal acetylation
  MISC_FEATURE (20)..(20): C-terminal amidation
TGLVSMGWYDYNFDHYREFT

SEQ ID NO: 264 - protein, 20 aa, Artificial Sequence
  Synthetic peptide
  MISC_FEATURE (1)..(1): N-terminal acetylation
  MISC_FEATURE (20)..(20): C-terminal amidation
TGLVSAMWYDYNFDHYREFT

SEQ ID NO: 265 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGMYDYNFDHYREFT

SEQ ID NO: 266 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWMDYNFDHYREFT

SEQ ID NO: 267 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYMYNFDHYREFT

SEQ ID NO: 268 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYDMNFDHYREFT

SEQ ID NO: 269 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYDYMFDHYREFT

SEQ ID NO: 270 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYDYNMDHYREFT

SEQ ID NO: 271 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYDYNFMHYREFT

SEQ ID NO: 272 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYDYNFDMYREFT

SEQ ID NO: 273 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYDYNFDHMREFT

SEQ ID NO: 274 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYDYNFDHYMEFT

SEQ ID NO: 275 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYDYNFDHYRMFT

SEQ ID NO: 276 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYDYNFDHYREMT

SEQ ID NO: 277 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYDYNFDHYREFM

SEQ ID NO: 278 - protein, 20 aa, Artificial Sequence
  Synthetic peptide
  MISC_FEATURE (1)..(1): N-terminal acetylation
  MISC_FEATURE (20)..(20): C-terminal amidation
NGLVSAGWYDYNFDHYREFT

SEQ ID NO: 279 - protein, 20 aa, Artificial Sequence
  Synthetic peptide
  MISC_FEATURE (1)..(1): N-terminal acetylation
  MISC_FEATURE (20)..(20): C-terminal amidation
TNLVSAGWYDYNFDHYREFT

SEQ ID NO: 280 - protein, 20 aa, Artificial Sequence
  Synthetic peptide
  MISC_FEATURE (1)..(1): N-terminal acetylation
  MISC_FEATURE (20)..(20): C-terminal amidation
TGNVSAGWYDYNFDHYREFT

SEQ ID NO: 281 - protein, 20 aa, Artificial Sequence
  Synthetic peptide
  MISC_FEATURE (1)..(1): N-terminal acetylation
  MISC_FEATURE (20)..(20): C-terminal amidation
TGLNSAGWYDYNFDHYREFT

SEQ ID NO: 282 - protein, 20 aa, Artificial Sequence
  Synthetic peptide
  MISC_FEATURE (1)..(1): N-terminal acetylation
  MISC_FEATURE (20)..(20): C-terminal amidation
TGLVNAGWYDYNFDHYREFT

SEQ ID NO: 283 - protein, 20 aa, Artificial Sequence
  Synthetic peptide
  MISC_FEATURE (1)..(1): N-terminal acetylation
  MISC_FEATURE (20)..(20): C-terminal amidation
TGLVSNGWYDYNFDHYREFT

SEQ ID NO: 284 - protein, 20 aa, Artificial Sequence
  Synthetic peptide
  MISC_FEATURE (1)..(1): N-terminal acetylation
  MISC_FEATURE (20)..(20): C-terminal amidation
TGLVSANWYDYNFDHYREFT

SEQ ID NO: 285 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGNYDYNFDHYREFT

SEQ ID NO: 286 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWNDYNFDHYREFT

SEQ ID NO: 287 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYNYNFDHYREFT

SEQ ID NO: 288 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYDNNFDHYREFT

SEQ ID NO: 289 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYDYNNDHYREFT

SEQ ID NO: 290 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYDYNFNHYREFT

SEQ ID NO: 291 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYDYNFDNYREFT

SEQ ID NO: 292 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYDYNFDHNREFT

SEQ ID NO: 293 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYDYNFDHYNEFT

SEQ ID NO: 294 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYDYNFDHYRNFT

SEQ ID NO: 295 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYDYNFDHYRENT

SEQ ID NO: 296 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYDYNFDHYREFN

SEQ ID NO: 297 - protein, 20 aa, Artificial Sequence
  Synthetic peptide
  MISC_FEATURE (1)..(1): N-terminal acetylation
  MISC_FEATURE (20)..(20): C-terminal amidation
QGLVSAGWYDYNFDHYREFT

SEQ ID NO: 298 - protein, 20 aa, Artificial Sequence
  Synthetic peptide
  MISC_FEATURE (1)..(1): N-terminal acetylation
  MISC_FEATURE (20)..(20): C-terminal amidation
TQLVSAGWYDYNFDHYREFT

SEQ ID NO: 299 - protein, 20 aa, Artificial Sequence
  Synthetic peptide
  MISC_FEATURE (1)..(1): N-terminal acetylation
  MISC_FEATURE (20)..(20): C-terminal amidation
TGQVSAGWYDYNFDHYREFT

SEQ ID NO: 300 - protein, 20 aa, Artificial Sequence
  Synthetic peptide
  MISC_FEATURE (1)..(1): N-terminal acetylation
  MISC_FEATURE (20)..(20): C-terminal amidation
TGLQSAGWYDYNFDHYREFT

SEQ ID NO: 301 - protein, 20 aa, Artificial Sequence
  Synthetic peptide
  MISC_FEATURE (1)..(1): N-terminal acetylation
  MISC_FEATURE (20)..(20): C-terminal amidation
TGLVQAGWYDYNFDHYREFT

SEQ ID NO: 302 - protein, 20 aa, Artificial Sequence
  Synthetic peptide
  MISC_FEATURE (1)..(1): N-terminal acetylation
  MISC_FEATURE (20)..(20): C-terminal amidation
TGLVSQGWYDYNFDHYREFT

SEQ ID NO: 303 - protein, 20 aa, Artificial Sequence
  Synthetic peptide
  MISC_FEATURE (1)..(1): N-terminal acetylation
  MISC_FEATURE (20)..(20): C-terminal amidation
TGLVSAQWYDYNFDHYREFT

SEQ ID NO: 304 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGQYDYNFDHYREFT

SEQ ID NO: 305 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWQDYNFDHYREFT

SEQ ID NO: 306 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYQYNFDHYREFT

SEQ ID NO: 307 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYDQNFDHYREFT

SEQ ID NO: 308 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYDYQFDHYREFT

SEQ ID NO: 309 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYDYNQDHYREFT

SEQ ID NO: 310 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYDYNFQHYREFT

SEQ ID NO: 311 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYDYNFDQYREFT

SEQ ID NO: 312 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYDYNFDHQREFT

SEQ ID NO: 313 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYDYNFDHYQEFT

SEQ ID NO: 314 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYDYNFDHYRQFT

SEQ ID NO: 315 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYDYNFDHYREQT

SEQ ID NO: 316 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYDYNFDHYREFQ

SEQ ID NO: 317 - protein, 20 aa, Artificial Sequence
  Synthetic peptide
  MISC_FEATURE (1)..(1): N-terminal acetylation
  MISC_FEATURE (20)..(20): C-terminal amidation
RGLVSAGWYDYNFDHYREFT

SEQ ID NO: 318 - protein, 20 aa, Artificial Sequence
  Synthetic peptide
  MISC_FEATURE (1)..(1): N-terminal acetylation
  MISC_FEATURE (20)..(20): C-terminal amidation
TRLVSAGWYDYNFDHYREFT

SEQ ID NO: 319 - protein, 20 aa, Artificial Sequence
  Synthetic peptide
  MISC_FEATURE (1)..(1): N-terminal acetylation
  MISC_FEATURE (20)..(20): C-terminal amidation
TGRVSAGWYDYNFDHYREFT

SEQ ID NO: 320 - protein, 20 aa, Artificial Sequence
  Synthetic peptide
  MISC_FEATURE (1)..(1): N-terminal acetylation
  MISC_FEATURE (20)..(20): C-terminal amidation
TGLRSAGWYDYNFDHYREFT

SEQ ID NO: 321 - protein, 20 aa, Artificial Sequence
  Synthetic peptide
  MISC_FEATURE (1)..(1): N-terminal acetylation
  MISC_FEATURE (20)..(20): C-terminal amidation
TGLVRAGWYDYNFDHYREFT

SEQ ID NO: 322 - protein, 20 aa, Artificial Sequence
  Synthetic peptide
  MISC_FEATURE (1)..(1): N-terminal acetylation
  MISC_FEATURE (20)..(20): C-terminal amidation
TGLVSRGWYDYNFDHYREFT

SEQ ID NO: 323 - protein, 20 aa, Artificial Sequence
  Synthetic peptide
  MISC_FEATURE (1)..(1): N-terminal acetylation
  MISC_FEATURE (20)..(20): C-terminal amidation
TGLVSARWYDYNFDHYREFT

SEQ ID NO: 324 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGRYDYNFDHYREFT

SEQ ID NO: 325 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWRDYNFDHYREFT

SEQ ID NO: 326 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYRYNFDHYREFT

SEQ ID NO: 327 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYDRNFDHYREFT

SEQ ID NO: 328 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYDYRFDHYREFT

SEQ ID NO: 329 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYDYNRDHYREFT

SEQ ID NO: 330 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYDYNFRHYREFT

SEQ ID NO: 331 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYDYNFDRYREFT

SEQ ID NO: 332 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYDYNFDHRREFT

SEQ ID NO: 333 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYDYNFDHYRRFT

SEQ ID NO: 334 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYDYNFDHYRERT

SEQ ID NO: 335 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYDYNFDHYREFR

SEQ ID NO: 336 - protein, 20 aa, Artificial Sequence
  Synthetic peptide
  MISC_FEATURE (1)..(1): N-terminal acetylation
  MISC_FEATURE (20)..(20): C-terminal amidation
TTLVSAGWYDYNFDHYREFT

SEQ ID NO: 337 - protein, 20 aa, Artificial Sequence
  Synthetic peptide
  MISC_FEATURE (1)..(1): N-terminal acetylation
  MISC_FEATURE (20)..(20): C-terminal amidation
TGTVSAGWYDYNFDHYREFT

SEQ ID NO: 338 - protein, 20 aa, Artificial Sequence
  Synthetic peptide
  MISC_FEATURE (1)..(1): N-terminal acetylation
  MISC_FEATURE (20)..(20): C-terminal amidation
TGLTSAGWYDYNFDHYREFT

SEQ ID NO: 339 - protein, 20 aa, Artificial Sequence
  Synthetic peptide
  MISC_FEATURE (1)..(1): N-terminal acetylation
  MISC_FEATURE (20)..(20): C-terminal amidation
TGLVTAGWYDYNFDHYREFT

SEQ ID NO: 340 - protein, 20 aa, Artificial Sequence
  Synthetic peptide
  MISC_FEATURE (1)..(1): N-terminal acetylation
  MISC_FEATURE (20)..(20): C-terminal amidation
TGLVSTGWYDYNFDHYREFT

SEQ ID NO: 341 - protein, 20 aa, Artificial Sequence
  Synthetic peptide
  MISC_FEATURE (1)..(1): N-terminal acetylation
  MISC_FEATURE (20)..(20): C-terminal amidation
TGLVSATWYDYNFDHYREFT

SEQ ID NO: 342 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGTYDYNFDHYREFT

SEQ ID NO: 343 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWTDYNFDHYREFT

SEQ ID NO: 344 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYTYNFDHYREFT

SEQ ID NO: 345 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYDTNFDHYREFT

SEQ ID NO: 346 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYDYTFDHYREFT

SEQ ID NO: 347 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYDYNTDHYREFT

SEQ ID NO: 348 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYDYNFTHYREFT

SEQ ID NO: 349 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYDYNFDTYREFT

SEQ ID NO: 350 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYDYNFDHTREFT

SEQ ID NO: 351 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYDYNFDHYTEFT

SEQ ID NO: 352 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYDYNFDHYRTFT

SEQ ID NO: 353 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYDYNFDHYRETT

SEQ ID NO: 354 - protein, 20 aa, Artificial Sequence
  Synthetic peptide
  MISC_FEATURE (1)..(1): N-terminal acetylation
  MISC_FEATURE (20)..(20): C-terminal amidation
VGLVSAGWYDYNFDHYREFT

SEQ ID NO: 355 - protein, 20 aa, Artificial Sequence
  Synthetic peptide
  MISC_FEATURE (1)..(1): N-terminal acetylation
  MISC_FEATURE (20)..(20): C-terminal amidation
TVLVSAGWYDYNFDHYREFT

SEQ ID NO: 356 - protein, 20 aa, Artificial Sequence
  Synthetic peptide
  MISC_FEATURE (1)..(1): N-terminal acetylation
  MISC_FEATURE (20)..(20): C-terminal amidation
TGVVSAGWYDYNFDHYREFT

SEQ ID NO: 357 - protein, 20 aa, Artificial Sequence
  Synthetic peptide
  MISC_FEATURE (1)..(1): N-terminal acetylation
  MISC_FEATURE (20)..(20): C-terminal amidation
TGLVVAGWYDYNFDHYREFT

SEQ ID NO: 358 - protein, 20 aa, Artificial Sequence
  Synthetic peptide
  MISC_FEATURE (1)..(1): N-terminal acetylation
  MISC_FEATURE (20)..(20): C-terminal amidation
TGLVSVGWYDYNFDHYREFT

SEQ ID NO: 359 - protein, 20 aa, Artificial Sequence
  Synthetic peptide
  MISC_FEATURE (1)..(1): N-terminal acetylation
  MISC_FEATURE (20)..(20): C-terminal amidation
TGLVSAVWYDYNFDHYREFT

SEQ ID NO: 360 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGVYDYNFDHYREFT

SEQ ID NO: 361 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWVDYNFDHYREFT

SEQ ID NO: 362 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYVYNFDHYREFT

SEQ ID NO: 363 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYDVNFDHYREFT

SEQ ID NO: 364 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYDYVFDHYREFT

SEQ ID NO: 365 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYDYNVDHYREFT

SEQ ID NO: 366 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYDYNFVHYREFT

SEQ ID NO: 367 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYDYNFDVYREFT

SEQ ID NO: 368 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYDYNFDHVREFT

SEQ ID NO: 369 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYDYNFDHYVEFT

SEQ ID NO: 370 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYDYNFDHYRVFT

SEQ ID NO: 371 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYDYNFDHYREVT

SEQ ID NO: 372 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYDYNFDHYREFV

SEQ ID NO: 373 - protein, 20 aa, Artificial Sequence
  Synthetic peptide
  MISC_FEATURE (1)..(1): N-terminal acetylation
  MISC_FEATURE (20)..(20): C-terminal amidation
WGLVSAGWYDYNFDHYREFT

SEQ ID NO: 374 - protein, 20 aa, Artificial Sequence
  Synthetic peptide
  MISC_FEATURE (1)..(1): N-terminal acetylation
  MISC_FEATURE (20)..(20): C-terminal amidation
TWLVSAGWYDYNFDHYREFT

SEQ ID NO: 375 - protein, 20 aa, Artificial Sequence
  Synthetic peptide
  MISC_FEATURE (1)..(1): N-terminal acetylation
  MISC_FEATURE (20)..(20): C-terminal amidation
TGWVSAGWYDYNFDHYREFT

SEQ ID NO: 376 - protein, 20 aa, Artificial Sequence
  Synthetic peptide
  MISC_FEATURE (1)..(1): N-terminal acetylation
  MISC_FEATURE (20)..(20): C-terminal amidation
TGLWSAGWYDYNFDHYREFT

SEQ ID NO: 377 - protein, 20 aa, Artificial Sequence
  Synthetic peptide
  MISC_FEATURE (1)..(1): N-terminal acetylation
  MISC_FEATURE (20)..(20): C-terminal amidation
TGLVWAGWYDYNFDHYREFT

SEQ ID NO: 378 - protein, 20 aa, Artificial Sequence
  Synthetic peptide
  MISC_FEATURE (1)..(1): N-terminal acetylation
  MISC_FEATURE (20)..(20): C-terminal amidation
TGLVSWGWYDYNFDHYREFT

SEQ ID NO: 379 - protein, 20 aa, Artificial Sequence
  Synthetic peptide
  MISC_FEATURE (1)..(1): N-terminal acetylation
  MISC_FEATURE (20)..(20): C-terminal amidation
TGLVSAWWYDYNFDHYREFT

SEQ ID NO: 380 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWWDYNFDHYREFT

SEQ ID NO: 381 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYWYNFDHYREFT

SEQ ID NO: 382 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYDWNFDHYREFT

SEQ ID NO: 383 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYDYWFDHYREFT

SEQ ID NO: 384 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYDYNWDHYREFT

SEQ ID NO: 385 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYDYNFWHYREFT

SEQ ID NO: 386 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYDYNFDWYREFT

SEQ ID NO: 387 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYDYNFDHWREFT

SEQ ID NO: 388 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYDYNFDHYWEFT

SEQ ID NO: 389 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYDYNFDHYRWFT

SEQ ID NO: 390 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYDYNFDHYREWT

SEQ ID NO: 391 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYDYNFDHYREFW

SEQ ID NO: 392 - protein, 20 aa, Artificial Sequence
  Synthetic peptide
  MISC_FEATURE (1)..(1): N-terminal acetylation
  MISC_FEATURE (20)..(20): C-terminal amidation
YGLVSAGWYDYNFDHYREFT

SEQ ID NO: 393 - protein, 20 aa, Artificial Sequence
  Synthetic peptide
  MISC_FEATURE (1)..(1): N-terminal acetylation
  MISC_FEATURE (20)..(20): C-terminal amidation
TYLVSAGWYDYNFDHYREFT

SEQ ID NO: 394 - protein, 20 aa, Artificial Sequence
  Synthetic peptide
  MISC_FEATURE (1)..(1): N-terminal acetylation
  MISC_FEATURE (20)..(20): C-terminal amidation
TGYVSAGWYDYNFDHYREFT

SEQ ID NO: 395 - protein, 20 aa, Artificial Sequence
  Synthetic peptide
  MISC_FEATURE (1)..(1): N-terminal acetylation
  MISC_FEATURE (20)..(20): C-terminal amidation
TGLYSAGWYDYNFDHYREFT

SEQ ID NO: 396 - protein, 20 aa, Artificial Sequence
  Synthetic peptide
  MISC_FEATURE (1)..(1): N-terminal acetylation
  MISC_FEATURE (20)..(20): C-terminal amidation
TGLVYAGWYDYNFDHYREFT

SEQ ID NO: 397 - protein, 20 aa, Artificial Sequence
  Synthetic peptide
  MISC_FEATURE (1)..(1): N-terminal acetylation
  MISC_FEATURE (20)..(20): C-terminal amidation
TGLVSYGWYDYNFDHYREFT

SEQ ID NO: 398 - protein, 20 aa, Artificial Sequence
  Synthetic peptide
  MISC_FEATURE (1)..(1): N-terminal acetylation
  MISC_FEATURE (20)..(20): C-terminal amidation
TGLVSAYWYDYNFDHYREFT

SEQ ID NO: 399 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGYYDYNFDHYREFT

SEQ ID NO: 400 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYYYNFDHYREFT

SEQ ID NO: 401 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYDYYFDHYREFT

SEQ ID NO: 402 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYDYNYDHYREFT

SEQ ID NO: 403 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYDYNFYHYREFT

SEQ ID NO: 404 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYDYNFDYYREFT

SEQ ID NO: 405 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYDYNFDHYYEFT

SEQ ID NO: 406 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYDYNFDHYRYFT

SEQ ID NO: 407 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYDYNFDHYREYT

SEQ ID NO: 408 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYDYNFDHYREFY

SEQ ID NO: 409 - protein, 21 aa, Artificial Sequence
  Synthetic peptide
  MISC_FEATURE (1)..(1): N-terminal acetylation
  MISC_FEATURE (21)..(21): N-ethylmaleiimido Cys
  MISC_FEATURE (21)..(21): C-terminal amidation
TGLVSAGWYDYNFDHYREFTC

SEQ ID NO: 410 - protein, 21 aa, Artificial Sequence
  Synthetic peptide
  MISC_FEATURE (1)..(1): N-terminal acetylation
  MISC_FEATURE (1)..(1): N-ethylmaleiimido Cys
  MISC_FEATURE (21)..(21): C-terminal amidation
CTGLVSAGWYDYNFDHYREFT

SEQ ID NO: 411 - protein, 21 aa, Artificial Sequence
  Synthetic peptide
  MISC_FEATURE (1)..(1): N-terminal acetylation
  DISULFID (1)..(10): Cys residues linked via disulfide bond
  MISC_FEATURE (21)..(21): C-terminal amidation
CGLVSAGWYCDYNFDHYREFT

SEQ ID NO: 412 - protein, 21 aa, Artificial Sequence
  Synthetic peptide
  MISC_FEATURE (1)..(1): N-terminal acetylation
  DISULFID (1)..(11): Cys residues linked via disulfide bond
  MISC_FEATURE (21)..(21): C-terminal amidation
CGLVSAGWYDCYNFDHYREFT

SEQ ID NO: 413 - protein, 21 aa, Artificial Sequence
  Synthetic peptide
  MISC_FEATURE (1)..(1): N-terminal acetylation
  DISULFID (1)..(12): Cys residues linked via disulfide bond
  MISC_FEATURE (21)..(21): C-terminal amidation
CGLVSAGWYDYCNFDHYREFT

SEQ ID NO: 414 - protein, 21 aa, Artificial Sequence
  Synthetic peptide
  MISC_FEATURE (1)..(1): N-terminal acetylation
  DISULFID (1)..(13): Cys residues linked via disulfide bond
  MISC_FEATURE (21)..(21): C-terminal amidation
CGLVSAGWYDYNCFDHYREFT

SEQ ID NO: 415 - protein, 21 aa, Artificial Sequence
  Synthetic peptide
  MISC_FEATURE (1)..(1): N-terminal acetylation
  DISULFID (1)..(14): Cys residues linked via disulfide bond
  MISC_FEATURE (21)..(21): C-terminal amidation
CGLVSAGWYDYNFCDHYREFT

SEQ ID NO: 416 - protein, 21 aa, Artificial Sequence
  Synthetic peptide
  MISC_FEATURE (1)..(1): N-terminal acetylation
  DISULFID (2)..(10): Cys residues linked via disulfide bond
  MISC_FEATURE (21)..(21): C-terminal amidation
TCLVSAGWYCDYNFDHYREFT

SEQ ID NO: 417 - protein, 21 aa, Artificial Sequence
  Synthetic peptide
  MISC_FEATURE (1)..(1): N-terminal acetylation
  DISULFID (2)..(11): Cys residues linked via disulfide bond
  MISC_FEATURE (21)..(21): C-terminal amidation
TCLVSAGWYDCYNFDHYREFT

SEQ ID NO: 418 - protein, 21 aa, Artificial Sequence
  Synthetic peptide
  MISC_FEATURE (1)..(1): N-terminal acetylation
  DISULFID (2)..(12): Cys residues linked via disulfide bond
  MISC_FEATURE (21)..(21): C-terminal amidation
TCLVSAGWYDYCNFDHYREFT

SEQ ID NO: 419 - protein, 21 aa, Artificial Sequence
  Synthetic peptide
  MISC_FEATURE (1)..(1): N-terminal acetylation
  DISULFID (2)..(13): Cys residues linked via disulfide bond
  MISC_FEATURE (21)..(21): C-terminal amidation
TCLVSAGWYDYNCFDHYREFT

SEQ ID NO: 420 - protein, 21 aa, Artificial Sequence
  Synthetic peptide
  MISC_FEATURE (1)..(1): N-terminal acetylation
  DISULFID (2)..(14): Cys residues linked via disulfide bond
  MISC_FEATURE (21)..(21): C-terminal amidation
TCLVSAGWYDYNFCDHYREFT

SEQ ID NO: 421 - protein, 20 aa, Artificial Sequence
  Synthetic peptide
  MISC_FEATURE (1)..(1): N-terminal acetylation
  DISULFID (5)..(13): Cys residues linked via disulfide bond
  MISC_FEATURE (20)..(20): C-terminal amidation
TGLVCAGWYDYNCDHYREFT

SEQ ID NO: 422 - protein, 21 aa, Artificial Sequence
  Synthetic peptide
  MISC_FEATURE (1)..(1): N-terminal acetylation
  DISULFID (5)..(14): Cys residues linked via disulfide bond
  MISC_FEATURE (20)..(20): C-terminal amidation
TGLVCSAGWYDYNCDHYREFT

SEQ ID NO: 423 - protein, 21 aa, Artificial Sequence
  Synthetic peptide
  MISC_FEATURE (1)..(1): N-terminal acetylation
  DISULFID (4)..(14): Cys residues linked via disulfide bond
  MISC_FEATURE (21)..(21): C-terminal amidation
TGLCVSAGWYDYNCDHYREFT

SEQ ID NO: 424 - protein, 21 aa, Artificial Sequence
  Synthetic peptide
  MISC_FEATURE (1)..(1): N-terminal acetylation
  DISULFID (3)..(14): Cys residues linked via disulfide bond
  MISC_FEATURE (21)..(21): C-terminal amidation
TGCLVSAGWYDYNCDHYREFT

SEQ ID NO: 425 - protein, 20 aa, Artificial Sequence
  Synthetic peptide
  MISC_FEATURE (1)..(1): N-terminal acetylation
  DISULFID (1)..(13): Cys residues linked via disulfide bond
  MISC_FEATURE (20)..(20): C-terminal amidation
CGLVSAGWYDYNCDHYREFT

SEQ ID NO: 426 - protein, 20 aa, Artificial Sequence
  Synthetic peptide
  MISC_FEATURE (1)..(1): N-terminal acetylation
  DISULFID (2)..(13): Cys residues linked via disulfide bond
  MISC_FEATURE (20)..(20): C-terminal amidation
TCLVSAGWYDYNCDHYREFT

SEQ ID NO: 427 - protein, 20 aa, Artificial Sequence
  Synthetic peptide
  MISC_FEATURE (1)..(1): N-terminal acetylation
  DISULFID (1)..(15): Cys residues linked via disulfide bond
  MISC_FEATURE (20)..(20): C-terminal amidation
CGLVSAGWYDYNFDCYREFT

SEQ ID NO: 428 - protein, 20 aa, Artificial Sequence
  Synthetic peptide
  MISC_FEATURE (1)..(1): N-terminal acetylation
  DISULFID (1)..(15): Cys residues linked via disulfide bond
  MISC_FEATURE (20)..(20): C-terminal amidation
TCLVSAGWYDYNFDCYREFT

SEQ ID NO: 429 - protein, 20 aa, Artificial Sequence
  Synthetic peptide
  MISC_FEATURE (1)..(1): N-terminal acetylation
  MISC_FEATURE (20)..(20): C-terminal amidation
CGLVSAGWYDYNFDCYREFT

SEQ ID NO: 430 - protein, 20 aa, Artificial Sequence
  Synthetic peptide
  MISC_FEATURE (1)..(1): N-terminal acetylation
  MISC_FEATURE (20)..(20): C-terminal amidation
CGLVSAGWYDYNCDHYREFT

SEQ ID NO: 431 - protein, 21 aa, Artificial Sequence
  Synthetic peptide
  MISC_FEATURE (1)..(1): N-terminal acetylation
  MISC_FEATURE (21)..(21): C-terminal amidation
TGCLVSAGWYDYNCDHYREFT

SEQ ID NO: 432 - protein, 21 aa, Artificial Sequence
  Synthetic peptide
  MISC_FEATURE (1)..(1): N-terminal acetylation
  MISC_FEATURE (21)..(21): C-terminal amidation
CGLVSAGWYDCYNFDHYREFT

SEQ ID NO: 433 - protein, 21 aa, Artificial Sequence
  Synthetic peptide
  MISC_FEATURE (1)..(1): N-terminal acetylation
  MISC_FEATURE (21)..(21): Maleiimide at each end of a 40kDa 4-brached PEG reacts with C-terminal Cysteine on each of four peptides identical to this sequence to form central tetravalent core
  MISC_FEATURE (21)..(21): C-terminal amidation
TGLVSAGWYDYNFDHYREFTC

SEQ ID NO: 434 - protein, 19 aa, Artificial Sequence
  Synthetic peptide
  MISC_FEATURE (1)..(1): N-terminal acetylation
  MISC_FEATURE (19)..(19): C-terminal amidation
GLVSAGWYDYNFDHYREFT

SEQ ID NO: 435 - protein, 19 aa, Artificial Sequence
  Synthetic peptide
  MISC_FEATURE (1)..(1): N-terminal acetylation
  MISC_FEATURE (19)..(19): C-terminal amidation
TGLVSAGWYDYNFDHYREF

SEQ ID NO: 436 - protein, 18 aa, Artificial Sequence
  Synthetic peptide
  MISC_FEATURE (1)..(1): N-terminal acetylation
  MISC_FEATURE (18)..(18): C-terminal amidation
GLVSAGWYDYNFDHYREF

SEQ ID NO: 437 - protein, 20 aa, Artificial Sequence
  Synthetic peptide
  MISC_FEATURE (1)..(1): N-terminal acetylation
  MISC_FEATURE (20)..(20): C-terminal amidation
SGLVSAGWYDYNFDSYREFT

SEQ ID NO: 438 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYDYNFDTYMEFT

SEQ ID NO: 439 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYDYNFDVYMEFT

SEQ ID NO: 440 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYDYNFDTYTEFT

SEQ ID NO: 441 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYDYNFDVYTEFT

SEQ ID NO: 442 - protein, 20 aa, Artificial Sequence
  Synthetic peptide
  MISC_FEATURE (1)..(1): N-terminal acetylation
  MISC_FEATURE (20)..(20): C-terminal amidation
YGLVSAGWYDYNFDTYREFT

SEQ ID NO: 443 - protein, 20 aa, Artificial Sequence
  Synthetic peptide
  MISC_FEATURE (1)..(1): N-terminal acetylation
  MISC_FEATURE (20)..(20): C-terminal amidation
YGLVSAGWYDYNFDVYREFT

SEQ ID NO: 444 - protein, 20 aa, Artificial Sequence
  Synthetic peptide
  MISC_FEATURE (1)..(1): N-terminal acetylation
  MISC_FEATURE (20)..(20): C-terminal amidation
TGLVEAGWYDYNFDTYREFT

SEQ ID NO: 445 - protein, 20 aa, Artificial Sequence
  Synthetic peptide
  MISC_FEATURE (1)..(1): N-terminal acetylation
  MISC_FEATURE (20)..(20): C-terminal amidation
TGLVEAGWYDYNFDVYREFT

SEQ ID NO: 446 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYDYNNDTYREFT

SEQ ID NO: 447 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYDYNNDVYREFT

SEQ ID NO: 448 - protein, 20 aa, Artificial Sequence
  Synthetic peptide
  MISC_FEATURE (1)..(1): N-terminal acetylation
  MISC_FEATURE (20)..(20): C-terminal amidation
YGLVSAGWYDYNFDHYMEFT

SEQ ID NO: 449 - protein, 20 aa, Artificial Sequence
  Synthetic peptide
  MISC_FEATURE (1)..(1): N-terminal acetylation
  MISC_FEATURE (20)..(20): C-terminal amidation
TGLVEAGWYDYNFDHYMEFT

SEQ ID NO: 450 - protein, 20 aa, Artificial Sequence
  Synthetic peptide
  MISC_FEATURE (1)..(1): N-terminal acetylation
  MISC_FEATURE (20)..(20): C-terminal amidation
TGLVSAGWYDYNNDHYMEFT

SEQ ID NO: 451 - protein, 20 aa, Artificial Sequence
  Synthetic peptide
  MISC_FEATURE (1)..(1): N-terminal acetylation
  MISC_FEATURE (15)..(15): Xaa is tert-Leu
  MISC_FEATURE (20)..(20): C-terminal amidation
TGLVSAGWYDYNFDXYREFT

SEQ ID NO: 452 - protein, 20 aa, Artificial Sequence
  Synthetic peptide
  MISC_FEATURE (1)..(1): N-terminal acetylation
  MISC_FEATURE (17)..(17): Xaa is norleucine (Nle)
  MISC_FEATURE (20)..(20): C-terminal amidation
TGLVSAGWYDYNFDHYXEFT

SEQ ID NO: 453 - protein, 20 aa, Artificial Sequence
  Synthetic peptide
  MISC_FEATURE (1)..(1): N-terminal acetylation
  MISC_FEATURE (20)..(20): C-terminal amidation
YGLVEAGWYDYNNDTYMEFT

SEQ ID NO: 454 - protein, 20 aa, Artificial Sequence
  Synthetic peptide
  MISC_FEATURE (1)..(1): N-terminal acetylation
  MISC_FEATURE (4)..(4): Xaa is Tert-Leu (Tle)
  MISC_FEATURE (20)..(20): C-terminal amidation
TGLXSAGWYDYNFDTYREFT

SEQ ID NO: 455 - protein, 20 aa, Artificial Sequence
  Synthetic peptide
  MISC_FEATURE (1)..(1): N-terminal acetylation
  MISC_FEATURE (4)..(4): Xaa is tert-Leu (Tle)
  MISC_FEATURE (20)..(20): C-terminal amidation
TGLXSAGWYDYNFDHYMEFT

SEQ ID NO: 456 - protein, 20 aa, Artificial Sequence
  Synthetic peptide
  MISC_FEATURE (1)..(1): N-terminal acetylation
  MISC_FEATURE (4)..(4): Xaa tert-Leu (Tle)
  MISC_FEATURE (20)..(20): C-terminal amidation
TGLXSAGWYDYNFDTYMEFT

SEQ ID NO: 457 - protein, 21 aa, Artificial Sequence
  Synthetic peptide
  MISC_FEATURE (1)..(1): N-terminal acetylation
  MISC_FEATURE (21)..(21): Xaa is 2-amino-3-(4-benzoylphenyl)-propanoic acid (Bpa)
  MISC_FEATURE (21)..(21): C-terminal amidation
TGLVSAGWYDYNFDHYREFTX

SEQ ID NO: 458 - protein, 21 aa, Artificial Sequence
  Synthetic peptide
  MISC_FEATURE (1)..(1): N-terminal acetylation
  MISC_FEATURE (21)..(21): C-terminal amidation
TGLVSAGWYDYNFDHYREFTC

SEQ ID NO: 459 - protein, 21 aa, Artificial Sequence
  Synthetic peptide
  MISC_FEATURE (1)..(1): N-terminal acetylation
  MISC_FEATURE (21)..(21): C-terminal amidation
CTGLVSAGWYDYNFDHYREFT

SEQ ID NO: 460 - protein, 21 aa, Artificial Sequence
  Synthetic peptide
  MISC_FEATURE (1)..(1): N-terminal acetylation
  MISC_FEATURE (1)..(1): Xaa is 2-amino-3-(4-benzoylphenyl)-propanoic acid (Bpa)
  MISC_FEATURE (20)..(20): C-terminal amidation
XTGLVSAGWYDYNFDHYREFT

SEQ ID NO: 461 - protein, 21 aa, Artificial Sequence
  Synthetic peptide
  MISC_FEATURE (1)..(1): N-terminal acetylation
  MISC_FEATURE (21)..(21): C-terminal amidation
MEYYVSAGWYDYNTDTYYEFE

SEQ ID NO: 462 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTDTYYEFE

SEQ ID NO: 463 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNDDKYYEFE

SEQ ID NO: 464 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNNDIYYEFE

SEQ ID NO: 465 - protein, 20 aa, Artificial Sequence
  Synthetic peptide
  MISC_FEATURE (1)..(1): N-terminal acetylation
  MISC_FEATURE (20)..(20): C-terminal amidation
EYTVSAGWYDYNNDIYFEFY

SEQ ID NO: 466 - protein, 20 aa, Artificial Sequence
  Synthetic peptide
  MISC_FEATURE (1)..(1): N-terminal acetylation
  MISC_FEATURE (20)..(20): C-terminal amidation
EYTVSAGWYDYNKDTYEEFK

SEQ ID NO: 467 - protein, 20 aa, Artificial Sequence
  Synthetic peptide
  MISC_FEATURE (1)..(1): N-terminal acetylation
  MISC_FEATURE (20)..(20): C-terminal amidation
YGIVSAGWYDYNTDTYYEFY

SEQ ID NO: 468 - protein, 20 aa, Artificial Sequence
  Synthetic peptide
  MISC_FEATURE (1)..(1): N-terminal acetylation
  MISC_FEATURE (20)..(20): C-terminal amidation
EGYVSAGWYDYNTDTYYEFE

SEQ ID NO: 469 - protein, 20 aa, Artificial Sequence
  Synthetic peptide
  MISC_FEATURE (1)..(1): N-terminal acetylation
  MISC_FEATURE (20)..(20): C-terminal amidation
ESYVSAGWYDYNTDTYYEFF

SEQ ID NO: 470 - protein, 21 aa, Artificial Sequence
  Synthetic peptide
  MISC_FEATURE (21)..(21): C-terminal amidation
MEYYVSAGWYDYNTDTYYEFE

SEQ ID NO: 471 - protein, 21 aa, Artificial Sequence
  Synthetic peptide
  MISC_FEATURE (1)..(1): N-terminal acetylation
  MISC_FEATURE (21)..(21): Covalently bound to 4-azido-2,3,5,6-tetrafluorobenzoic acid (Atf) which is covalently bound to biotin
  MISC_FEATURE (21)..(21): C-terminal amidation
TGLVSAGWYDYNFDHYREFTC

SEQ ID NO: 472 - protein, 21 aa, Artificial Sequence
  Synthetic peptide
  MISC_FEATURE (1)..(1): N-terminal acetylation
  MISC_FEATURE (21)..(21): Covalently bound to 2-amino ethenethiol which is bound to carboxyl group of Lys; Epsilon amino of Lys bound to biotin via linker; Alpha amine of Lys bound to 4-azido-2,3,5,6-tetrafluorobenzoic acid (Atf) via linker
  MISC_FEATURE (21)..(21): C-terminal amidation
TGLVSAGWYDYNFDHYREFTC

SEQ ID NO: 473 - protein, 21 aa, Artificial Sequence
  Synthetic peptide
  MISC_FEATURE (1)..(1): N-terminal acetylation
  MISC_FEATURE (1)..(1): Cys (Atf-Bio)
  MISC_FEATURE (21)..(21): C-terminal amidation
CTGLVSAGWYDYNFDHYREFT

SEQ ID NO: 474 - protein, 21 aa, Artificial Sequence
  Synthetic peptide
  MISC_FEATURE (1)..(1): N-terminal acetylation
  MISC_FEATURE (1)..(1): Cys(Atf-LC-Bio)
  MISC_FEATURE (21)..(21): C-terminal amidation
CTGLVSAGWYDYNFDHYREFT

SEQ ID NO: 475 - protein, 22 aa, Artificial Sequence
  Synthetic peptide
  MISC_FEATURE (1)..(1): N-terminal acetylation
  MISC_FEATURE (21)..(21): Xaa is 2-amino-3-(4-benzoylphenyl)-propanoic acid (Bpa)
  MISC_FEATURE (22)..(22): Covelently bound to biotin via epsilon amino group
  MISC_FEATURE (22)..(22): C-terminal amidation
TGLVSAGWYDYNFDHYREFTXK

SEQ ID NO: 476 - protein, 21 aa, Artificial Sequence
  Synthetic peptide
  MISC_FEATURE (1)..(1): Xaa is 2-amino-3-(4-benzoylphenyl)-propanoic acid (Bpa)
  MISC_FEATURE (21)..(21): C-terminal amidation
XTGLVSAGWYDYNFDHYREFT

SEQ ID NO: 477 - protein, 20 aa, Artificial Sequence
  Synthetic peptide
  MISC_FEATURE (1)..(1): N-terminal acetylation
  MISC_FEATURE (1)..(1): N-terminal acetylation
  MISC_FEATURE (20)..(20): C-terminal amidation
EYYVSAGWYDYNTDTYYEFD

SEQ ID NO: 478 - protein, 20 aa, Artificial Sequence
  Synthetic peptide
  MISC_FEATURE (1)..(1): N-terminal acetylation
  MISC_FEATURE (1)..(1): N-terminal acetylation
  MISC_FEATURE (20)..(20): C-terminal amidation
EYYVTAGWYDYNTDTYYEFE

SEQ ID NO: 479 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNNDTYYEFE

SEQ ID NO: 480 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNADTYYEFE

SEQ ID NO: 481 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYMTDTYTEFE

SEQ ID NO: 482 - protein, 20 aa, Artificial Sequence
  Synthetic peptide
  MISC_FEATURE (1)..(1): N-terminal acetylation
  MISC_FEATURE (20)..(20): C-terminal amidation
EYYVEAGWYEYNTDNYYPFE

SEQ ID NO: 483 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTDKYYEFI

SEQ ID NO: 484 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTDRYYEFY

SEQ ID NO: 485 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDTNNDRYYEFI

SEQ ID NO: 486 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNNDIYYEFI

SEQ ID NO: 487 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNNDIYLEFE

SEQ ID NO: 488 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWHDYNKDIYFEFF

SEQ ID NO: 489 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNNDTYNEFW

SEQ ID NO: 490 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNSDTYQEFI

SEQ ID NO: 491 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNSDTYFEFI

SEQ ID NO: 492 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYEHDTYLEFY

SEQ ID NO: 493 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYNYEEDSYYEFE

SEQ ID NO: 494 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNYDVYTEFE

SEQ ID NO: 495 - protein, 20 aa, Artificial Sequence
  Synthetic peptide
  MISC_FEATURE (1)..(1): N-terminal acetylation
  MISC_FEATURE (20)..(20): C-terminal amidation
EQYVSAGWYGYNTDTYYEFD

SEQ ID NO: 496 - protein, 20 aa, Artificial Sequence
  Synthetic peptide
  MISC_FEATURE (1)..(1): N-terminal acetylation
  MISC_FEATURE (20)..(20): C-terminal amidation
TYYVSAGWYGYNNDRYYEFY

SEQ ID NO: 497 - protein, 20 aa, Artificial Sequence
  Synthetic peptide
  MISC_FEATURE (1)..(1): N-terminal acetylation
  MISC_FEATURE (20)..(20): C-terminal amidation
QYYVVAGWYDYNTDSYYEFD

SEQ ID NO: 498 - protein, 20 aa, Artificial Sequence
  Synthetic peptide
  MISC_FEATURE (1)..(1): N-terminal acetylation
  MISC_FEATURE (20)..(20): C-terminal amidation
EEYVSAGWYDMNRDTYTEFY

SEQ ID NO: 499 - protein, 20 aa, Artificial Sequence
  Synthetic peptide
  MISC_FEATURE (1)..(1): N-terminal acetylation
  MISC_FEATURE (20)..(20): C-terminal amidation
EYTVSAGWYNYNADEYYEFE

SEQ ID NO: 500 - protein, 20 aa, Artificial Sequence
  Synthetic peptide
  MISC_FEATURE (1)..(1): N-terminal acetylation
  MISC_FEATURE (20)..(20): C-terminal amidation
EYTISAGWYDYNTDMYYEFV

SEQ ID NO: 501 - protein, 20 aa, Artificial Sequence
  Synthetic peptide
  MISC_FEATURE (1)..(1): N-terminal acetylation
  MISC_FEATURE (20)..(20): C-terminal amidation
EYTASAGWYDYNSDTYYEFE

SEQ ID NO: 502 - protein, 20 aa, Artificial Sequence
  Synthetic peptide
  MISC_FEATURE (1)..(1): N-terminal acetylation
  MISC_FEATURE (20)..(20): C-terminal amidation
YGIVEAGWYEYNTDEYIEFW

SEQ ID NO: 503 - protein, 20 aa, Artificial Sequence
  Synthetic peptide
  MISC_FEATURE (1)..(1): N-terminal acetylation
  MISC_FEATURE (20)..(20): C-terminal amidation
YGIVSAGWYEYNTDIYEEFW

SEQ ID NO: 504 - protein, 20 aa, Artificial Sequence
  Synthetic peptide
  MISC_FEATURE (1)..(1): N-terminal acetylation
  MISC_FEATURE (20)..(20): C-terminal amidation
YGIVSAGWYDMNNDYYFEFY

SEQ ID NO: 505 - protein, 20 aa, Artificial Sequence
  Synthetic peptide
  MISC_FEATURE (1)..(1): N-terminal acetylation
  MISC_FEATURE (20)..(20): C-terminal amidation
EGYVSAGWYDYNKDIYLEFE

SEQ ID NO: 506 - protein, 20 aa, Artificial Sequence
  Synthetic peptide
  MISC_FEATURE (1)..(1): N-terminal acetylation
  MISC_FEATURE (20)..(20): C-terminal amidation
EGYVSAGWYDYNQDIYFEFA

SEQ ID NO: 507 - protein, 20 aa, Artificial Sequence
  Synthetic peptide
  MISC_FEATURE (1)..(1): N-terminal acetylation
  MISC_FEATURE (20)..(20): C-terminal amidation
ESYVSAGWYDYNIDAYYEFY

SEQ ID NO: 508 - protein, 20 aa, Artificial Sequence
  Synthetic peptide
  MISC_FEATURE (1)..(1): N-terminal acetylation
  MISC_FEATURE (20)..(20): C-terminal amidation
ESYVSAGWYDYNTDTYYEFY

SEQ ID NO: 509 - protein, 20 aa, Artificial Sequence
  Synthetic peptide
  MISC_FEATURE (1)..(1): N-terminal acetylation
  MISC_FEATURE (20)..(20): C-terminal amidation
EYIVTAGWYDYNKDIYYEFK

SEQ ID NO: 510 - protein, 20 aa, Artificial Sequence
  Synthetic peptide
  MISC_FEATURE (1)..(1): N-terminal acetylation
  MISC_FEATURE (20)..(20): C-terminal amidation
EYIVEAGWYDINEDKYLEFY

SEQ ID NO: 511 - protein, 20 aa, Artificial Sequence
  Synthetic peptide
  MISC_FEATURE (1)..(1): N-terminal acetylation
  MISC_FEATURE (20)..(20): C-terminal amidation
EYSVSAGWYDYYNDTYYEFY

SEQ ID NO: 512 - protein, 20 aa, Artificial Sequence
  Synthetic peptide
  MISC_FEATURE (1)..(1): N-terminal acetylation
  MISC_FEATURE (20)..(20): C-terminal amidation
EYSVSAGWYDYNTDVYYEFE

SEQ ID NO: 513 - protein, 20 aa, Artificial Sequence
  Synthetic peptide
  MISC_FEATURE (1)..(1): N-terminal acetylation
  MISC_FEATURE (20)..(20): C-terminal amidation
ESIVSAGWYDYNTDEYYEFF

SEQ ID NO: 514 - protein, 20 aa, Artificial Sequence
  Synthetic peptide
  MISC_FEATURE (1)..(1): N-terminal acetylation
  MISC_FEATURE (20)..(20): C-terminal amidation
ESIVSAGWYDYNTDTYYEFT

SEQ ID NO: 515 - protein, 20 aa, Artificial Sequence
  Synthetic peptide
  MISC_FEATURE (1)..(1): N-terminal acetylation
  MISC_FEATURE (20)..(20): C-terminal amidation
FGIVSAGWYDYNTDTYYEPY

SEQ ID NO: 516 - protein, 20 aa, Artificial Sequence
  Synthetic peptide
  MISC_FEATURE (1)..(1): N-terminal acetylation
  MISC_FEATURE (20)..(20): C-terminal amidation
FGIISAGWYDYNEDAYSEFY

SEQ ID NO: 517 - protein, 20 aa, Artificial Sequence
  Synthetic peptide
  MISC_FEATURE (1)..(1): N-terminal acetylation
  MISC_FEATURE (20)..(20): C-terminal amidation
FEYVSAGWYDYNTDTYYEFY

SEQ ID NO: 518 - protein, 20 aa, Artificial Sequence
  Synthetic peptide
  MISC_FEATURE (1)..(1): N-terminal acetylation
  MISC_FEATURE (20)..(20): C-terminal amidation
FEYVIAGWYDYNTDTYHEFN

SEQ ID NO: 519 - protein, 20 aa, Artificial Sequence
  Synthetic peptide
  MISC_FEATURE (1)..(1): N-terminal acetylation
  MISC_FEATURE (20)..(20): C-terminal amidation
SATVSAGWYDYNKDVYFEFE

SEQ ID NO: 520 - protein, 20 aa, Artificial Sequence
  Synthetic peptide
  MISC_FEATURE (1)..(1): N-terminal acetylation
  MISC_FEATURE (20)..(20): C-terminal amidation
EVIVSAGWYDYNNDIYYEFW

SEQ ID NO: 521 - protein, 20 aa, Artificial Sequence
  Synthetic peptide
  MISC_FEATURE (1)..(1): N-terminal acetylation
  MISC_FEATURE (20)..(20): C-terminal amidation
EVHVSAGWYDYNNDTYYEFG

SEQ ID NO: 522 - protein, 20 aa, Artificial Sequence
  Synthetic peptide
  MISC_FEATURE (1)..(1): N-terminal acetylation
  MISC_FEATURE (20)..(20): C-terminal amidation
EVEVSAGWYDYNDDKYYEFG

SEQ ID NO: 523 - protein, 20 aa, Artificial Sequence
  Synthetic peptide
  MISC_FEATURE (1)..(1): N-terminal acetylation
  MISC_FEATURE (20)..(20): C-terminal amidation
EYEVSAGWYDYNNDVYNEFY

SEQ ID NO: 524 - protein, 20 aa, Artificial Sequence
  Synthetic peptide
  MISC_FEATURE (1)..(1): N-terminal acetylation
  MISC_FEATURE (20)..(20): C-terminal amidation
EYFVSAGWYDYNADIYYEFD

SEQ ID NO: 525 - protein, 20 aa, Artificial Sequence
  Synthetic peptide
  MISC_FEATURE (1)..(1): N-terminal acetylation
  MISC_FEATURE (20)..(20): C-terminal amidation
YNIVSAGWYDYNKDTYYEFF

SEQ ID NO: 526 - protein, 20 aa, Artificial Sequence
  Synthetic peptide
  MISC_FEATURE (1)..(1): N-terminal acetylation
  MISC_FEATURE (20)..(20): C-terminal amidation
YNEVSAGWYDMNEDTYYEFY

SEQ ID NO: 527 - protein, 20 aa, Artificial Sequence
  Synthetic peptide
  MISC_FEATURE (1)..(1): N-terminal acetylation
  MISC_FEATURE (20)..(20): C-terminal amidation
YVEVSAGWYDYNTDTYSEFW

SEQ ID NO: 528 - protein, 20 aa, Artificial Sequence
  Synthetic peptide
  MISC_FEATURE (1)..(1): N-terminal acetylation
  MISC_FEATURE (20)..(20): C-terminal amidation
EVEVSAGWYEYNTDTYYEFW

SEQ ID NO: 529 - protein, 20 aa, Artificial Sequence
  Synthetic peptide
  MISC_FEATURE (1)..(1): N-terminal acetylation
  MISC_FEATURE (20)..(20): C-terminal amidation
AIYVTAGWYDYNNDTYYEFT

SEQ ID NO: 530 - protein, 20 aa, Artificial Sequence
  Synthetic peptide
  MISC_FEATURE (1)..(1): N-terminal acetylation
  MISC_FEATURE (20)..(20): C-terminal amidation
HIYVTAGWYDYNTDTYHEFE

SEQ ID NO: 531 - protein, 20 aa, Artificial Sequence
  Synthetic peptide
  MISC_FEATURE (1)..(1): N-terminal acetylation
  MISC_FEATURE (20)..(20): C-terminal amidation
RYIVSAGWYDIIQDTYFEFY

SEQ ID NO: 532 - protein, 20 aa, Artificial Sequence
  Synthetic peptide
  MISC_FEATURE (1)..(1): N-terminal acetylation
  MISC_FEATURE (20)..(20): C-terminal amidation
NYIVSAGWYDYNNDEYIEFY

SEQ ID NO: 533 - protein, 20 aa, Artificial Sequence
  Synthetic peptide
  MISC_FEATURE (1)..(1): N-terminal acetylation
  MISC_FEATURE (20)..(20): C-terminal amidation
EVYVSAGWYNYNEDAYYEFW

SEQ ID NO: 534 - protein, 20 aa, Artificial Sequence
  Synthetic peptide
  MISC_FEATURE (1)..(1): N-terminal acetylation
  MISC_FEATURE (20)..(20): C-terminal amidation
DVYVSAGWYDYNEDTYYEFS

SEQ ID NO: 535 - protein, 20 aa, Artificial Sequence
  Synthetic peptide
  MISC_FEATURE (1)..(1): N-terminal acetylation
  MISC_FEATURE (20)..(20): C-terminal amidation
NMYVSAGWYNYNEDTYEEFY

SEQ ID NO: 536 - protein, 20 aa, Artificial Sequence
  Synthetic peptide
  MISC_FEATURE (1)..(1): N-terminal acetylation
  MISC_FEATURE (20)..(20): C-terminal amidation
NMEVSAGWYDYNSDTYHEFW

SEQ ID NO: 537 - protein, 20 aa, Artificial Sequence
  Synthetic peptide
  MISC_FEATURE (1)..(1): N-terminal acetylation
  MISC_FEATURE (20)..(20): C-terminal amidation
EATVSIGWYDYNKDEYYEFY

SEQ ID NO: 538 - protein, 20 aa, Artificial Sequence
  Synthetic peptide
  MISC_FEATURE (1)..(1): N-terminal acetylation
  MISC_FEATURE (20)..(20): C-terminal amidation
EFIVSAGWYDYNKDTYIEFE

SEQ ID NO: 539 - protein, 20 aa, Artificial Sequence
  Synthetic peptide
  MISC_FEATURE (1)..(1): N-terminal acetylation
  MISC_FEATURE (20)..(20): C-terminal amidation
EAMVSAGWYDYMNDTYYEFE

SEQ ID NO: 540 - protein, 20 aa, Artificial Sequence
  Synthetic peptide
  MISC_FEATURE (1)..(1): N-terminal acetylation
  MISC_FEATURE (20)..(20): C-terminal amidation
EHIVSAGWYDYNMDEYYEFW

SEQ ID NO: 541 - protein, 20 aa, Artificial Sequence
  Synthetic peptide
  MISC_FEATURE (1)..(1): N-terminal acetylation
  MISC_FEATURE (20)..(20): C-terminal amidation
DDEVSIGWYDYNTDEYVEFW

SEQ ID NO: 542 - protein, 20 aa, Artificial Sequence
  Synthetic peptide
  MISC_FEATURE (1)..(1): N-terminal acetylation
  MISC_FEATURE (20)..(20): C-terminal amidation
DVHVSAGWYDYNKDIYYEFT

SEQ ID NO: 543 - protein, 20 aa, Artificial Sequence
  Synthetic peptide
  MISC_FEATURE (1)..(1): N-terminal acetylation
  MISC_FEATURE (20)..(20): C-terminal amidation
DNYVSAGWYDYNTDTYYEFY

SEQ ID NO: 544 - protein, 20 aa, Artificial Sequence
  Synthetic peptide
  MISC_FEATURE (1)..(1): N-terminal acetylation
  MISC_FEATURE (20)..(20): C-terminal amidation
KMHVSIGWYDYNNDIYYEFY

SEQ ID NO: 545 - protein, 20 aa, Artificial Sequence
  Synthetic peptide
  MISC_FEATURE (1)..(1): N-terminal acetylation
  MISC_FEATURE (20)..(20): C-terminal amidation
KVEVSAGWYDYNKDVYYEFE

SEQ ID NO: 546 - protein, 20 aa, Artificial Sequence
  Synthetic peptide
  MISC_FEATURE (1)..(1): N-terminal acetylation
  MISC_FEATURE (20)..(20): C-terminal amidation
KDKVSAGWYDYNSDTYYEFT

SEQ ID NO: 547 - protein, 20 aa, Artificial Sequence
  Synthetic peptide
  MISC_FEATURE (1)..(1): N-terminal acetylation
  MISC_FEATURE (20)..(20): C-terminal amidation
IIMVSAGWYDYNTDTYYEFE

SEQ ID NO: 548 - protein, 20 aa, Artificial Sequence
  Synthetic peptide
  MISC_FEATURE (1)..(1): N-terminal acetylation
  MISC_FEATURE (20)..(20): C-terminal amidation
ITHVTAGWYDYNTDTYYEFI

SEQ ID NO: 549 - protein, 20 aa, Artificial Sequence
  Synthetic peptide
  MISC_FEATURE (1)..(1): N-terminal acetylation
  MISC_FEATURE (20)..(20): C-terminal amidation
VIEVSAGWYDYNEDKYYEFW

SEQ ID NO: 550 - protein, 20 aa, Artificial Sequence
  Synthetic peptide
  MISC_FEATURE (1)..(1): N-terminal acetylation
  MISC_FEATURE (20)..(20): C-terminal amidation
VFYVSAGWYDYNDDKYYEFW

SEQ ID NO: 551 - protein, 20 aa, Artificial Sequence
  Synthetic peptide
  MISC_FEATURE (1)..(1): N-terminal acetylation
  MISC_FEATURE (20)..(20): C-terminal amidation
AYIVEAGWYDYNTDTYEEFW

SEQ ID NO: 552 - protein, 20 aa, Artificial Sequence
  Synthetic peptide
  MISC_FEATURE (1)..(1): N-terminal acetylation
  MISC_FEATURE (20)..(20): C-terminal amidation
HWYVSAGWYDYNEDKYYEFE

SEQ ID NO: 553 - protein, 20 aa, Artificial Sequence
  Synthetic peptide
  MISC_FEATURE (1)..(1): N-terminal acetylation
  MISC_FEATURE (20)..(20): C-terminal amidation
HYNVSAGWYDYNNDEYFEFY

SEQ ID NO: 554 - protein, 20 aa, Artificial Sequence
  Synthetic peptide
  MISC_FEATURE (1)..(1): N-terminal acetylation
  MISC_FEATURE (20)..(20): C-terminal amidation
WYEVEIGWYDYNTDTYQEFY

SEQ ID NO: 555 - protein, 20 aa, Artificial Sequence
  Synthetic peptide
  MISC_FEATURE (1)..(1): N-terminal acetylation
  MISC_FEATURE (20)..(20): C-terminal amidation
YVTVSAGWYDYNKDEYFEFY

SEQ ID NO: 556 - protein, 20 aa, Artificial Sequence
  Synthetic peptide
  MISC_FEATURE (1)..(1): N-terminal acetylation
  MISC_FEATURE (20)..(20): C-terminal amidation
NFTVSAGWYDYNKDEYYEFY

SEQ ID NO: 557 - protein, 20 aa, Artificial Sequence
  Synthetic peptide
  MISC_FEATURE (1)..(1): N-terminal acetylation
  MISC_FEATURE (20)..(20): C-terminal amidation
SYEVSAGWYDYNTDTYYEFQ

SEQ ID NO: 558 - protein, 19 aa, Artificial Sequence
  Synthetic peptide
  MISC_FEATURE (1)..(1): N-terminal acetylation
  MISC_FEATURE (19)..(19): C-terminal amidation
EYYVSAGWYDYNTDTYYEF

SEQ ID NO: 559 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTDTYYEFN

SEQ ID NO: 560 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTDTYYEFT

SEQ ID NO: 561 - protein, 21 aa, Artificial Sequence
  Synthetic peptide
  MISC_FEATURE (1)..(1): N-terminal acetylation
  MISC_FEATURE (21)..(21): Covalently bound to fluorescent dye (Cy5-Dye) via maleimide coupled to thiol
  MISC_FEATURE (21)..(21): C-terminal amidation
TGLVSAGWYDYNFDHYREFTC

SEQ ID NO: 562 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XEYYVSAGWYDYNTDTYYEFE

SEQ ID NO: 563 - protein, 20 aa, Artificial Sequence
  Synthetic peptide
  MISC_FEATURE (1)..(1): N-terminal acetylation
  MISC_FEATURE (4)..(4): Xaa is tert-Leu (Tle)
  MISC_FEATURE (20)..(20): C-terminal amidation
EYYXSAGWYDYNTDTYYEFE

SEQ ID NO: 564 - protein, 21 aa, Artificial Sequence
  Synthetic peptide
  MISC_FEATURE (1)..(1): N-terminal acetylation
  MISC_FEATURE (21)..(21): Covalently bound to 400Mal-PEG
  MISC_FEATURE (21)..(21): C-terminal amidation
EYYVSAGWYDYNTDTYYEFEC

SEQ ID NO: 565 - protein, 21 aa, Artificial Sequence
  Synthetic peptide
  MISC_FEATURE (1)..(1): N-terminal acetylation
  MISC_FEATURE (21)..(21): C-terminal amidation
EYYVSAGWYDYNTDTYYEFEC

SEQ ID NO: 566 - protein, 21 aa, Artificial Sequence
  Synthetic peptide
  MISC_FEATURE (1)..(1): N-terminal acetylation
  MISC_FEATURE (21)..(21): N-ethylmaleiimido Cys
  MISC_FEATURE (21)..(21): C-terminal amidation
EYYVSAGWYDYNTDTYYEFEC

SEQ ID NO: 567 - protein, 21 aa, Artificial Sequence
  Synthetic peptide
  MISC_FEATURE (1)..(1): N-terminal acetylation
  MISC_FEATURE (21)..(21): Maleiimide at each end of a 40kDa 4-brached PEG reacts with C-terminal Cysteine on each of four peptides identical to this sequence to form central tetravalent core
  MISC_FEATURE (21)..(21): C-terminal amidation
EYYVSAGWYDYNTDTYYEFEC

SEQ ID NO: 568 - protein, 21 aa, Artificial Sequence
  Synthetic peptide
  MISC_FEATURE (1)..(1): N-terminal acetylation
  MISC_FEATURE (21)..(21): Cys(Me-400MA)
  MISC_FEATURE (21)..(21): C-terminal amidation
EYIVTAGWYDYNKDIYYEFKC

SEQ ID NO: 569 - protein, 20 aa, Artificial Sequence
  Synthetic peptide
  MISC_FEATURE (1)..(1): N-terminal acetylation
  MISC_FEATURE (20)..(20): C-terminal amidation
YAEYGYSVWDEEYNYTYTFD

SEQ ID NO: 570 - protein, 20 aa, Artificial Sequence
  Synthetic peptide
  MISC_FEATURE (1)..(1): N-terminal acetylation
  MISC_FEATURE (20)..(20): C-terminal amidation
YWYTDEDVYEFSYNYATYEG

SEQ ID NO: 571 - protein, 21 aa, Artificial Sequence
  Synthetic peptide
  MISC_FEATURE (1)..(1): N-terminal acetylation
  MISC_FEATURE (21)..(21): Epsilon-(Acetyl)-L-Lys
  MISC_FEATURE (21)..(21): C-terminal amidation
EYYVSAGWYDYNTDTYYEFEK

SEQ ID NO: 572 - protein, 22 aa, Artificial Sequence
  Synthetic peptide
  MISC_FEATURE (1)..(1): N-terminal acetylation
  MISC_FEATURE (1)..(1): Xaa is 6-aminohexanoic acid (Ahx)
  MISC_FEATURE (22)..(22): Epsilon-(Acetyl)-L-Lys
  MISC_FEATURE (22)..(22): C-terminal amidation
XEYYVSAGWYDYNTDTYYEFEK

SEQ ID NO: 573 - protein, 21 aa, Artificial Sequence
  Synthetic peptide
  MISC_FEATURE (1)..(1): N-terminal acetylation
  MISC_FEATURE (21)..(21): Covalently bound to FeBABE
  MISC_FEATURE (21)..(21): C-terminal amidation
EYYVSAGWYDYNTDTYYEFEC

SEQ ID NO: 574 - protein, 21 aa, Artificial Sequence
  Synthetic peptide
  MISC_FEATURE (1)..(1): N-terminal acetylation
  MISC_FEATURE (21)..(21): Cys(FeBABE)
  MISC_FEATURE (21)..(21): C-terminal amidation
YAEYGYSVWDEEYNYTYTFDC

SEQ ID NO: 575 - protein, 21 aa, Artificial Sequence
  Synthetic peptide
  MISC_FEATURE (1)..(1): N-terminal acetylation
  MISC_FEATURE (21)..(21): Covalently bound to Mal-Ttds
  MISC_FEATURE (21)..(21): C-terminal amidation
EYYVSAGWYDYNTDTYYEFEK

SEQ ID NO: 576 - protein, 20 aa, Artificial Sequence
  Synthetic peptide
  MISC_FEATURE (1)..(1): N-terminal acetylation
  MISC_FEATURE (20)..(20): C-terminal amidation
AYYVSAGWYDYNTDTYYEFE

SEQ ID NO: 577 - protein, 20 aa, Artificial Sequence
  Synthetic peptide
  MISC_FEATURE (1)..(1): N-terminal acetylation
  MISC_FEATURE (20)..(20): C-terminal amidation
EAYVSAGWYDYNTDTYYEFE

SEQ ID NO: 578 - protein, 20 aa, Artificial Sequence
  Synthetic peptide
  MISC_FEATURE (1)..(1): N-terminal acetylation
  MISC_FEATURE (20)..(20): C-terminal amidation
EYAVSAGWYDYNTDTYYEFE

SEQ ID NO: 579 - protein, 20 aa, Artificial Sequence
  Synthetic peptide
  MISC_FEATURE (1)..(1): N-terminal acetylation
  MISC_FEATURE (20)..(20): C-terminal amidation
EYYASAGWYDYNTDTYYEFE

SEQ ID NO: 580 - protein, 20 aa, Artificial Sequence
  Synthetic peptide
  MISC_FEATURE (1)..(1): N-terminal acetylation
  MISC_FEATURE (20)..(20): C-terminal amidation
EYYVAAGWYDYNTDTYYEFE

SEQ ID NO: 581 - protein, 20 aa, Artificial Sequence
  Synthetic peptide
  MISC_FEATURE (1)..(1): N-terminal acetylation
  MISC_FEATURE (20)..(20): C-terminal amidation
EYYVSAAWYDYNTDTYYEFE

SEQ ID NO: 582 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGAYDYNTDTYYEFE

SEQ ID NO: 583 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWADYNTDTYYEFE

SEQ ID NO: 584 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYAYNTDTYYEFE

SEQ ID NO: 585 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDANTDTYYEFE

SEQ ID NO: 586 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYATDTYYEFE

SEQ ID NO: 587 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTATYYEFE

SEQ ID NO: 588 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTDAYYEFE

SEQ ID NO: 589 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTDTAYEFE

SEQ ID NO: 590 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTDTYAEFE

SEQ ID NO: 591 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTDTYYAFE

SEQ ID NO: 592 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTDTYYEAE

SEQ ID NO: 593 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTDTYYEFA

SEQ ID NO: 594 - protein, 20 aa, Artificial Sequence
  Synthetic peptide
  MISC_FEATURE (1)..(1): N-terminal acetylation
  MISC_FEATURE (20)..(20): C-terminal amidation
CYYVSAGWYDYNTDTYYEFE

SEQ ID NO: 595 - protein, 20 aa, Artificial Sequence
  Synthetic peptide
  MISC_FEATURE (1)..(1): N-terminal acetylation
  MISC_FEATURE (20)..(20): C-terminal amidation
ECYVSAGWYDYNTDTYYEFE

SEQ ID NO: 596 - protein, 20 aa, Artificial Sequence
  Synthetic peptide
  MISC_FEATURE (1)..(1): N-terminal acetylation
  MISC_FEATURE (20)..(20): C-terminal amidation
EYCVSAGWYDYNTDTYYEFE

SEQ ID NO: 597 - protein, 20 aa, Artificial Sequence
  Synthetic peptide
  MISC_FEATURE (1)..(1): N-terminal acetylation
  MISC_FEATURE (20)..(20): C-terminal amidation
EYYCSAGWYDYNTDTYYEFE

SEQ ID NO: 598 - protein, 20 aa, Artificial Sequence
  Synthetic peptide
  MISC_FEATURE (1)..(1): N-terminal acetylation
  MISC_FEATURE (20)..(20): C-terminal amidation
EYYVCAGWYDYNTDTYYEFE

SEQ ID NO: 599 - protein, 20 aa, Artificial Sequence
  Synthetic peptide
  MISC_FEATURE (1)..(1): N-terminal acetylation
  MISC_FEATURE (20)..(20): C-terminal amidation
EYYVSCGWYDYNTDTYYEFE

SEQ ID NO: 600 - protein, 20 aa, Artificial Sequence
  Synthetic peptide
  MISC_FEATURE (1)..(1): N-terminal acetylation
  MISC_FEATURE (20)..(20): C-terminal amidation
EYYVSACWYDYNTDTYYEFE

SEQ ID NO: 601 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGCYDYNTDTYYEFE

SEQ ID NO: 602 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWCDYNTDTYYEFE

SEQ ID NO: 603 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYCYNTDTYYEFE

SEQ ID NO: 604 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDCNTDTYYEFE

SEQ ID NO: 605 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYCTDTYYEFE

SEQ ID NO: 606 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNCDTYYEFE

SEQ ID NO: 607 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTCTYYEFE

SEQ ID NO: 608 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTDCYYEFE

SEQ ID NO: 609 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTDTCYEFE

SEQ ID NO: 610 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTDTYCEFE

SEQ ID NO: 611 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTDTYYCFE

SEQ ID NO: 612 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTDTYYECE

SEQ ID NO: 613 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTDTYYEFC

SEQ ID NO: 614 - protein, 20 aa, Artificial Sequence
  Synthetic peptide
  MISC_FEATURE (1)..(1): N-terminal acetylation
  MISC_FEATURE (20)..(20): C-terminal amidation
DYYVSAGWYDYNTDTYYEFE

SEQ ID NO: 615 - protein, 20 aa, Artificial Sequence
  Synthetic peptide
  MISC_FEATURE (1)..(1): N-terminal acetylation
  MISC_FEATURE (20)..(20): C-terminal amidation
EDYVSAGWYDYNTDTYYEFE

SEQ ID NO: 616 - protein, 20 aa, Artificial Sequence
  Synthetic peptide
  MISC_FEATURE (1)..(1): N-terminal acetylation
  MISC_FEATURE (20)..(20): C-terminal amidation
EYDVSAGWYDYNTDTYYEFE

SEQ ID NO: 617 - protein, 20 aa, Artificial Sequence
  Synthetic peptide
  MISC_FEATURE (1)..(1): N-terminal acetylation
  MISC_FEATURE (20)..(20): C-terminal amidation
EYYDSAGWYDYNTDTYYEFE

SEQ ID NO: 618 - protein, 20 aa, Artificial Sequence
  Synthetic peptide
  MISC_FEATURE (1)..(1): N-terminal acetylation
  MISC_FEATURE (20)..(20): C-terminal amidation
EYYVDAGWYDYNTDTYYEFE

SEQ ID NO: 619 - protein, 20 aa, Artificial Sequence
  Synthetic peptide
  MISC_FEATURE (1)..(1): N-terminal acetylation
  MISC_FEATURE (20)..(20): C-terminal amidation
EYYVSDGWYDYNTDTYYEFE

SEQ ID NO: 620 - protein, 20 aa, Artificial Sequence
  Synthetic peptide
  MISC_FEATURE (1)..(1): N-terminal acetylation
  MISC_FEATURE (20)..(20): C-terminal amidation
EYYVSADWYDYNTDTYYEFE

SEQ ID NO: 621 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGDYDYNTDTYYEFE

SEQ ID NO: 622 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWDDYNTDTYYEFE

SEQ ID NO: 623 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDDNTDTYYEFE

SEQ ID NO: 624 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYDTDTYYEFE

SEQ ID NO: 625 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNDDTYYEFE

SEQ ID NO: 626 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTDDYYEFE

SEQ ID NO: 627 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTDTDYEFE

SEQ ID NO: 628 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTDTYDEFE

SEQ ID NO: 629 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTDTYYDFE

SEQ ID NO: 630 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTDTYYEDE

SEQ ID NO: 631 - protein, 20 aa, Artificial Sequence
  Synthetic peptide
  MISC_FEATURE (1)..(1): N-terminal acetylation
  MISC_FEATURE (20)..(20): C-terminal amidation
EEYVSAGWYDYNTDTYYEFE

SEQ ID NO: 632 - protein, 20 aa, Artificial Sequence
  Synthetic peptide
  MISC_FEATURE (1)..(1): N-terminal acetylation
  MISC_FEATURE (20)..(20): C-terminal amidation
EYEVSAGWYDYNTDTYYEFE

SEQ ID NO: 633 - protein, 20 aa, Artificial Sequence
  Synthetic peptide
  MISC_FEATURE (1)..(1): N-terminal acetylation
  MISC_FEATURE (20)..(20): C-terminal amidation
EYYESAGWYDYNTDTYYEFE

SEQ ID NO: 634 - protein, 20 aa, Artificial Sequence
  Synthetic peptide
  MISC_FEATURE (1)..(1): N-terminal acetylation
  MISC_FEATURE (20)..(20): C-terminal amidation
EYYVEAGWYDYNTDTYYEFE

SEQ ID NO: 635 - protein, 20 aa, Artificial Sequence
  Synthetic peptide
  MISC_FEATURE (1)..(1): N-terminal acetylation
  MISC_FEATURE (20)..(20): C-terminal amidation
EYYVSEGWYDYNTDTYYEFE

SEQ ID NO: 636 - protein, 20 aa, Artificial Sequence
  Synthetic peptide
  MISC_FEATURE (1)..(1): N-terminal acetylation
  MISC_FEATURE (20)..(20): C-terminal amidation
EYYVSAEWYDYNTDTYYEFE

SEQ ID NO: 637 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGEYDYNTDTYYEFE

SEQ ID NO: 638 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWEDYNTDTYYEFE

SEQ ID NO: 639 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYEYNTDTYYEFE

SEQ ID NO: 640 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDENTDTYYEFE

SEQ ID NO: 641 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYETDTYYEFE

SEQ ID NO: 642 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNEDTYYEFE

SEQ ID NO: 643 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTETYYEFE

SEQ ID NO: 644 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTDEYYEFE

SEQ ID NO: 645 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTDTEYEFE

SEQ ID NO: 646 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTDTYEEFE

SEQ ID NO: 647 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTDTYYEEE

SEQ ID NO: 648 - protein, 20 aa, Artificial Sequence
  Synthetic peptide
  MISC_FEATURE (1)..(1): N-terminal acetylation
  MISC_FEATURE (20)..(20): C-terminal amidation
FYYVSAGWYDYNTDTYYEFE

SEQ ID NO: 649 - protein, 20 aa, Artificial Sequence
  Synthetic peptide
  MISC_FEATURE (1)..(1): N-terminal acetylation
  MISC_FEATURE (20)..(20): C-terminal amidation
EFYVSAGWYDYNTDTYYEFE

SEQ ID NO: 650 - protein, 20 aa, Artificial Sequence
  Synthetic peptide
  MISC_FEATURE (1)..(1): N-terminal acetylation
  MISC_FEATURE (20)..(20): C-terminal amidation
EYFVSAGWYDYNTDTYYEFE

SEQ ID NO: 651 - protein, 20 aa, Artificial Sequence
  Synthetic peptide
  MISC_FEATURE (1)..(1): N-terminal acetylation
  MISC_FEATURE (20)..(20): C-terminal amidation
EYYFSAGWYDYNTDTYYEFE

SEQ ID NO: 652 - protein, 20 aa, Artificial Sequence
  Synthetic peptide
  MISC_FEATURE (1)..(1): N-terminal acetylation
  MISC_FEATURE (20)..(20): C-terminal amidation
EYYVFAGWYDYNTDTYYEFE

SEQ ID NO: 653 - protein, 20 aa, Artificial Sequence
  Synthetic peptide
  MISC_FEATURE (1)..(1): N-terminal acetylation
  MISC_FEATURE (20)..(20): C-terminal amidation
EYYVSFGWYDYNTDTYYEFE

SEQ ID NO: 654 - protein, 20 aa, Artificial Sequence
  Synthetic peptide
  MISC_FEATURE (1)..(1): N-terminal acetylation
  MISC_FEATURE (20)..(20): C-terminal amidation
EYYVSAFWYDYNTDTYYEFE

SEQ ID NO: 655 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGFYDYNTDTYYEFE

SEQ ID NO: 656 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWFDYNTDTYYEFE

SEQ ID NO: 657 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYFYNTDTYYEFE

SEQ ID NO: 658 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDFNTDTYYEFE

SEQ ID NO: 659 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYFTDTYYEFE

SEQ ID NO: 660 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNFDTYYEFE

SEQ ID NO: 661 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTFTYYEFE

SEQ ID NO: 662 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTDFYYEFE

SEQ ID NO: 663 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTDTFYEFE

SEQ ID NO: 664 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTDTYFEFE

SEQ ID NO: 665 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTDTYYFFE

SEQ ID NO: 666 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTDTYYEFF

SEQ ID NO: 667 - protein, 20 aa, Artificial Sequence
  Synthetic peptide
  MISC_FEATURE (1)..(1): N-terminal acetylation
  MISC_FEATURE (20)..(20): C-terminal amidation
GYYVSAGWYDYNTDTYYEFE

SEQ ID NO: 668 - protein, 20 aa, Artificial Sequence
  Synthetic peptide
  MISC_FEATURE (1)..(1): N-terminal acetylation
  MISC_FEATURE (20)..(20): C-terminal amidation
EYGVSAGWYDYNTDTYYEFE

SEQ ID NO: 669 - protein, 20 aa, Artificial Sequence
  Synthetic peptide
  MISC_FEATURE (1)..(1): N-terminal acetylation
  MISC_FEATURE (20)..(20): C-terminal amidation
EYYGSAGWYDYNTDTYYEFE

SEQ ID NO: 670 - protein, 20 aa, Artificial Sequence
  Synthetic peptide
  MISC_FEATURE (1)..(1): N-terminal acetylation
  MISC_FEATURE (20)..(20): C-terminal amidation
EYYVGAGWYDYNTDTYYEFE

SEQ ID NO: 671 - protein, 20 aa, Artificial Sequence
  Synthetic peptide
  MISC_FEATURE (1)..(1): N-terminal acetylation
  MISC_FEATURE (20)..(20): C-terminal amidation
EYYVSGGWYDYNTDTYYEFE

SEQ ID NO: 672 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGGYDYNTDTYYEFE

SEQ ID NO: 673 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWGDYNTDTYYEFE

SEQ ID NO: 674 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYGYNTDTYYEFE

SEQ ID NO: 675 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDGNTDTYYEFE

SEQ ID NO: 676 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYGTDTYYEFE

SEQ ID NO: 677 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNGDTYYEFE

SEQ ID NO: 678 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTGTYYEFE

SEQ ID NO: 679 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTDGYYEFE

SEQ ID NO: 680 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTDTGYEFE

SEQ ID NO: 681 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTDTYGEFE

SEQ ID NO: 682 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTDTYYGFE

SEQ ID NO: 683 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTDTYYEGE

SEQ ID NO: 684 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTDTYYEFG

SEQ ID NO: 685 - protein, 20 aa, Artificial Sequence
  Synthetic peptide
  MISC_FEATURE (1)..(1): N-terminal acetylation
  MISC_FEATURE (20)..(20): C-terminal amidation
HYYVSAGWYDYNTDTYYEFE

SEQ ID NO: 686 - protein, 20 aa, Artificial Sequence
  Synthetic peptide
  MISC_FEATURE (1)..(1): N-terminal acetylation
  MISC_FEATURE (20)..(20): C-terminal amidation
EHYVSAGWYDYNTDTYYEFE

SEQ ID NO: 687 - protein, 20 aa, Artificial Sequence
  Synthetic peptide
  MISC_FEATURE (1)..(1): N-terminal acetylation
  MISC_FEATURE (20)..(20): C-terminal amidation
EYHVSAGWYDYNTDTYYEFE

SEQ ID NO: 688 - protein, 20 aa, Artificial Sequence
  Synthetic peptide
  MISC_FEATURE (1)..(1): N-terminal acetylation
  MISC_FEATURE (20)..(20): C-terminal amidation
EYYHSAGWYDYNTDTYYEFE

SEQ ID NO: 689 - protein, 20 aa, Artificial Sequence
  Synthetic peptide
  MISC_FEATURE (1)..(1): N-terminal acetylation
  MISC_FEATURE (20)..(20): C-terminal amidation
EYYVHAGWYDYNTDTYYEFE

SEQ ID NO: 690 - protein, 20 aa, Artificial Sequence
  Synthetic peptide
  MISC_FEATURE (1)..(1): N-terminal acetylation
  MISC_FEATURE (20)..(20): C-terminal amidation
EYYVSHGWYDYNTDTYYEFE

SEQ ID NO: 691 - protein, 20 aa, Artificial Sequence
  Synthetic peptide
  MISC_FEATURE (1)..(1): N-terminal acetylation
  MISC_FEATURE (20)..(20): C-terminal amidation
EYYVSAHWYDYNTDTYYEFE

SEQ ID NO: 692 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGHYDYNTDTYYEFE

SEQ ID NO: 693 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWHDYNTDTYYEFE

SEQ ID NO: 694 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYHYNTDTYYEFE

SEQ ID NO: 695 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDHNTDTYYEFE

SEQ ID NO: 696 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYHTDTYYEFE

SEQ ID NO: 697 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNHDTYYEFE

SEQ ID NO: 698 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTHTYYEFE

SEQ ID NO: 699 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTDHYYEFE

SEQ ID NO: 700 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTDTHYEFE

SEQ ID NO: 701 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTDTYHEFE

SEQ ID NO: 702 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTDTYYHFE

SEQ ID NO: 703 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTDTYYEHE

SEQ ID NO: 704 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTDTYYEFH

SEQ ID NO: 705 - protein, 20 aa, Artificial Sequence
  Synthetic peptide
  MISC_FEATURE (1)..(1): N-terminal acetylation
  MISC_FEATURE (20)..(20): C-terminal amidation
IYYVSAGWYDYNTDTYYEFE

SEQ ID NO: 706 - protein, 20 aa, Artificial Sequence
  Synthetic peptide
  MISC_FEATURE (1)..(1): N-terminal acetylation
  MISC_FEATURE (20)..(20): C-terminal amidation
EIYVSAGWYDYNTDTYYEFE

SEQ ID NO: 707 - protein, 20 aa, Artificial Sequence
  Synthetic peptide
  MISC_FEATURE (1)..(1): N-terminal acetylation
  MISC_FEATURE (20)..(20): C-terminal amidation
EYIVSAGWYDYNTDTYYEFE

SEQ ID NO: 708 - protein, 20 aa, Artificial Sequence
  Synthetic peptide
  MISC_FEATURE (1)..(1): N-terminal acetylation
  MISC_FEATURE (20)..(20): C-terminal amidation
EYYISAGWYDYNTDTYYEFE

SEQ ID NO: 709 - protein, 20 aa, Artificial Sequence
  Synthetic peptide
  MISC_FEATURE (1)..(1): N-terminal acetylation
  MISC_FEATURE (20)..(20): C-terminal amidation
EYYVIAGWYDYNTDTYYEFE

SEQ ID NO: 710 - protein, 20 aa, Artificial Sequence
  Synthetic peptide
  MISC_FEATURE (1)..(1): N-terminal acetylation
  MISC_FEATURE (20)..(20): C-terminal amidation
EYYVSIGWYDYNTDTYYEFE

SEQ ID NO: 711 - protein, 20 aa, Artificial Sequence
  Synthetic peptide
  MISC_FEATURE (1)..(1): N-terminal acetylation
  MISC_FEATURE (20)..(20): C-terminal amidation
EYYVSAIWYDYNTDTYYEFE

SEQ ID NO: 712 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGIYDYNTDTYYEFE

SEQ ID NO: 713 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWIDYNTDTYYEFE

SEQ ID NO: 714 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYIYNTDTYYEFE

SEQ ID NO: 715 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDINTDTYYEFE

SEQ ID NO: 716 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYITDTYYEFE

SEQ ID NO: 717 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNIDTYYEFE

SEQ ID NO: 718 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTITYYEFE

SEQ ID NO: 719 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTDIYYEFE

SEQ ID NO: 720 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTDTIYEFE

SEQ ID NO: 721 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTDTYIEFE

SEQ ID NO: 722 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTDTYYIFE

SEQ ID NO: 723 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTDTYYEIE

SEQ ID NO: 724 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTDTYYEFI

SEQ ID NO: 725 - protein, 20 aa, Artificial Sequence
  Synthetic peptide
  MISC_FEATURE (1)..(1): N-terminal acetylation
  MISC_FEATURE (20)..(20): C-terminal amidation
KYYVSAGWYDYNTDTYYEFE

SEQ ID NO: 726 - protein, 20 aa, Artificial Sequence
  Synthetic peptide
  MISC_FEATURE (1)..(1): N-terminal acetylation
  MISC_FEATURE (20)..(20): C-terminal amidation
EKYVSAGWYDYNTDTYYEFE

SEQ ID NO: 727 - protein, 20 aa, Artificial Sequence
  Synthetic peptide
  MISC_FEATURE (1)..(1): N-terminal acetylation
  MISC_FEATURE (20)..(20): C-terminal amidation
EYKVSAGWYDYNTDTYYEFE

SEQ ID NO: 728 - protein, 20 aa, Artificial Sequence
  Synthetic peptide
  MISC_FEATURE (1)..(1): N-terminal acetylation
  MISC_FEATURE (20)..(20): C-terminal amidation
EYYKSAGWYDYNTDTYYEFE

SEQ ID NO: 729 - protein, 20 aa, Artificial Sequence
  Synthetic peptide
  MISC_FEATURE (1)..(1): N-terminal acetylation
  MISC_FEATURE (20)..(20): C-terminal amidation
EYYVKAGWYDYNTDTYYEFE

SEQ ID NO: 730 - protein, 20 aa, Artificial Sequence
  Synthetic peptide
  MISC_FEATURE (1)..(1): N-terminal acetylation
  MISC_FEATURE (20)..(20): C-terminal amidation
EYYVSKGWYDYNTDTYYEFE

SEQ ID NO: 731 - protein, 20 aa, Artificial Sequence
  Synthetic peptide
  MISC_FEATURE (1)..(1): N-terminal acetylation
  MISC_FEATURE (20)..(20): C-terminal amidation
EYYVSAKWYDYNTDTYYEFE

SEQ ID NO: 732 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGKYDYNTDTYYEFE

SEQ ID NO: 733 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWKDYNTDTYYEFE

SEQ ID NO: 734 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYKYNTDTYYEFE

SEQ ID NO: 735 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDKNTDTYYEFE

SEQ ID NO: 736 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYKTDTYYEFE

SEQ ID NO: 737 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNKDTYYEFE

SEQ ID NO: 738 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTKTYYEFE

SEQ ID NO: 739 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTDKYYEFE

SEQ ID NO: 740 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTDTKYEFE

SEQ ID NO: 741 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTDTYKEFE

SEQ ID NO: 742 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTDTYYKFE

SEQ ID NO: 743 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTDTYYEKE

SEQ ID NO: 744 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTDTYYEFK

SEQ ID NO: 745 - protein, 20 aa, Artificial Sequence
  Synthetic peptide
  MISC_FEATURE (1)..(1): N-terminal acetylation
  MISC_FEATURE (20)..(20): C-terminal amidation
LYYVSAGWYDYNTDTYYEFE

SEQ ID NO: 746 - protein, 20 aa, Artificial Sequence
  Synthetic peptide
  MISC_FEATURE (1)..(1): N-terminal acetylation
  MISC_FEATURE (20)..(20): C-terminal amidation
ELYVSAGWYDYNTDTYYEFE

SEQ ID NO: 747 - protein, 20 aa, Artificial Sequence
  Synthetic peptide
  MISC_FEATURE (1)..(1): N-terminal acetylation
  MISC_FEATURE (20)..(20): C-terminal amidation
EYLVSAGWYDYNTDTYYEFE

SEQ ID NO: 748 - protein, 20 aa, Artificial Sequence
  Synthetic peptide
  MISC_FEATURE (1)..(1): N-terminal acetylation
  MISC_FEATURE (20)..(20): C-terminal amidation
EYYLSAGWYDYNTDTYYEFE

SEQ ID NO: 749 - protein, 20 aa, Artificial Sequence
  Synthetic peptide
  MISC_FEATURE (1)..(1): N-terminal acetylation
  MISC_FEATURE (20)..(20): C-terminal amidation
EYYVLAGWYDYNTDTYYEFE

SEQ ID NO: 750 - protein, 20 aa, Artificial Sequence
  Synthetic peptide
  MISC_FEATURE (1)..(1): N-terminal acetylation
  MISC_FEATURE (20)..(20): C-terminal amidation
EYYVSLGWYDYNTDTYYEFE

SEQ ID NO: 751 - protein, 20 aa, Artificial Sequence
  Synthetic peptide
  MISC_FEATURE (1)..(1): N-terminal acetylation
  MISC_FEATURE (20)..(20): C-terminal amidation
EYYVSALWYDYNTDTYYEFE

SEQ ID NO: 752 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGLYDYNTDTYYEFE

SEQ ID NO: 753 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWLDYNTDTYYEFE

SEQ ID NO: 754 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYLYNTDTYYEFE

SEQ ID NO: 755 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDLNTDTYYEFE

SEQ ID NO: 756 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYLTDTYYEFE

SEQ ID NO: 757 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNLDTYYEFE

SEQ ID NO: 758 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTLTYYEFE

SEQ ID NO: 759 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTDLYYEFE

SEQ ID NO: 760 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTDTLYEFE

SEQ ID NO: 761 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTDTYLEFE

SEQ ID NO: 762 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTDTYYLFE

SEQ ID NO: 763 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTDTYYELE

SEQ ID NO: 764 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTDTYYEFL

SEQ ID NO: 765 - protein, 20 aa, Artificial Sequence
  Synthetic peptide
  MISC_FEATURE (1)..(1): N-terminal acetylation
  MISC_FEATURE (20)..(20): C-terminal amidation
MYYVSAGWYDYNTDTYYEFE

SEQ ID NO: 766 - protein, 20 aa, Artificial Sequence
  Synthetic peptide
  MISC_FEATURE (1)..(1): N-terminal acetylation
  MISC_FEATURE (20)..(20): C-terminal amidation
EMYVSAGWYDYNTDTYYEFE

SEQ ID NO: 767 - protein, 20 aa, Artificial Sequence
  Synthetic peptide
  MISC_FEATURE (1)..(1): N-terminal acetylation
  MISC_FEATURE (20)..(20): C-terminal amidation
EYMVSAGWYDYNTDTYYEFE

SEQ ID NO: 768 - protein, 20 aa, Artificial Sequence
  Synthetic peptide
  MISC_FEATURE (1)..(1): N-terminal acetylation
  MISC_FEATURE (20)..(20): C-terminal amidation
EYYMSAGWYDYNTDTYYEFE

SEQ ID NO: 769 - protein, 20 aa, Artificial Sequence
  Synthetic peptide
  MISC_FEATURE (1)..(1): N-terminal acetylation
  MISC_FEATURE (20)..(20): C-terminal amidation
EYYVMAGWYDYNTDTYYEFE

SEQ ID NO: 770 - protein, 20 aa, Artificial Sequence
  Synthetic peptide
  MISC_FEATURE (1)..(1): N-terminal acetylation
  MISC_FEATURE (20)..(20): C-terminal amidation
EYYVSMGWYDYNTDTYYEFE

SEQ ID NO: 771 - protein, 20 aa, Artificial Sequence
  Synthetic peptide
  MISC_FEATURE (1)..(1): N-terminal acetylation
  MISC_FEATURE (20)..(20): C-terminal amidation
EYYVSAMWYDYNTDTYYEFE

SEQ ID NO: 772 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGMYDYNTDTYYEFE

SEQ ID NO: 773 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWMDYNTDTYYEFE

SEQ ID NO: 774 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYMYNTDTYYEFE

SEQ ID NO: 775 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDMNTDTYYEFE

SEQ ID NO: 776 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYMTDTYYEFE

SEQ ID NO: 777 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNMDTYYEFE

SEQ ID NO: 778 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTMTYYEFE

SEQ ID NO: 779 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTDMYYEFE

SEQ ID NO: 780 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTDTMYEFE

SEQ ID NO: 781 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTDTYMEFE

SEQ ID NO: 782 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTDTYYMFE

SEQ ID NO: 783 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTDTYYEME

SEQ ID NO: 784 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTDTYYEFM

SEQ ID NO: 785 - protein, 20 aa, Artificial Sequence
  Synthetic peptide
  MISC_FEATURE (1)..(1): N-terminal acetylation
  MISC_FEATURE (20)..(20): C-terminal amidation
NYYVSAGWYDYNTDTYYEFE

SEQ ID NO: 786 - protein, 20 aa, Artificial Sequence
  Synthetic peptide
  MISC_FEATURE (1)..(1): N-terminal acetylation
  MISC_FEATURE (20)..(20): C-terminal amidation
ENYVSAGWYDYNTDTYYEFE

SEQ ID NO: 787 - protein, 20 aa, Artificial Sequence
  Synthetic peptide
  MISC_FEATURE (1)..(1): N-terminal acetylation
  MISC_FEATURE (20)..(20): C-terminal amidation
EYNVSAGWYDYNTDTYYEFE

SEQ ID NO: 788 - protein, 20 aa, Artificial Sequence
  Synthetic peptide
  MISC_FEATURE (1)..(1): N-terminal acetylation
  MISC_FEATURE (20)..(20): C-terminal amidation
EYYNSAGWYDYNTDTYYEFE

SEQ ID NO: 789 - protein, 20 aa, Artificial Sequence
  Synthetic peptide
  MISC_FEATURE (1)..(1): N-terminal acetylation
  MISC_FEATURE (20)..(20): C-terminal amidation
EYYVNAGWYDYNTDTYYEFE

SEQ ID NO: 790 - protein, 20 aa, Artificial Sequence
  Synthetic peptide
  MISC_FEATURE (1)..(1): N-terminal acetylation
  MISC_FEATURE (20)..(20): C-terminal amidation
EYYVSNGWYDYNTDTYYEFE

SEQ ID NO: 791 - protein, 20 aa, Artificial Sequence
  Synthetic peptide
  MISC_FEATURE (1)..(1): N-terminal acetylation
  MISC_FEATURE (20)..(20): C-terminal amidation
EYYVSANWYDYNTDTYYEFE

SEQ ID NO: 792 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGNYDYNTDTYYEFE

SEQ ID NO: 793 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWNDYNTDTYYEFE

SEQ ID NO: 794 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYNYNTDTYYEFE

SEQ ID NO: 795 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDNNTDTYYEFE

SEQ ID NO: 796 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTNTYYEFE

SEQ ID NO: 797 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTDNYYEFE

SEQ ID NO: 798 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTDTNYEFE

SEQ ID NO: 799 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTDTYNEFE

SEQ ID NO: 800 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTDTYYNFE

SEQ ID NO: 801 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTDTYYENE

SEQ ID NO: 802 - protein, 20 aa, Artificial Sequence
  Synthetic peptide
  MISC_FEATURE (1)..(1): N-terminal acetylation
  MISC_FEATURE (20)..(20): C-terminal amidation
PYYVSAGWYDYNTDTYYEFE

SEQ ID NO: 803 - protein, 20 aa, Artificial Sequence
  Synthetic peptide
  MISC_FEATURE (1)..(1): N-terminal acetylation
  MISC_FEATURE (20)..(20): C-terminal amidation
EPYVSAGWYDYNTDTYYEFE

SEQ ID NO: 804 - protein, 20 aa, Artificial Sequence
  Synthetic peptide
  MISC_FEATURE (1)..(1): N-terminal acetylation
  MISC_FEATURE (20)..(20): C-terminal amidation
EYPVSAGWYDYNTDTYYEFE

SEQ ID NO: 805 - protein, 20 aa, Artificial Sequence
  Synthetic peptide
  MISC_FEATURE (1)..(1): N-terminal acetylation
  MISC_FEATURE (20)..(20): C-terminal amidation
EYYPSAGWYDYNTDTYYEFE

SEQ ID NO: 806 - protein, 20 aa, Artificial Sequence
  Synthetic peptide
  MISC_FEATURE (1)..(1): N-terminal acetylation
  MISC_FEATURE (20)..(20): C-terminal amidation
EYYVPAGWYDYNTDTYYEFE

SEQ ID NO: 807 - protein, 20 aa, Artificial Sequence
  Synthetic peptide
  MISC_FEATURE (1)..(1): N-terminal acetylation
  MISC_FEATURE (20)..(20): C-terminal amidation
EYYVSPGWYDYNTDTYYEFE

SEQ ID NO: 808 - protein, 20 aa, Artificial Sequence
  Synthetic peptide
  MISC_FEATURE (1)..(1): N-terminal acetylation
  MISC_FEATURE (20)..(20): C-terminal amidation
EYYVSAPWYDYNTDTYYEFE

SEQ ID NO: 809 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGPYDYNTDTYYEFE

SEQ ID NO: 810 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWPDYNTDTYYEFE

SEQ ID NO: 811 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYPYNTDTYYEFE

SEQ ID NO: 812 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDPNTDTYYEFE

SEQ ID NO: 813 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYPTDTYYEFE

SEQ ID NO: 814 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNPDTYYEFE

SEQ ID NO: 815 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTPTYYEFE

SEQ ID NO: 816 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTDPYYEFE

SEQ ID NO: 817 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTDTPYEFE

SEQ ID NO: 818 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTDTYPEFE

SEQ ID NO: 819 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTDTYYPFE

SEQ ID NO: 820 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTDTYYEPE

SEQ ID NO: 821 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTDTYYEFP

SEQ ID NO: 822 - protein, 20 aa, Artificial Sequence
  Synthetic peptide
  MISC_FEATURE (1)..(1): N-terminal acetylation
  MISC_FEATURE (20)..(20): C-terminal amidation
QYYVSAGWYDYNTDTYYEFE

SEQ ID NO: 823 - protein, 20 aa, Artificial Sequence
  Synthetic peptide
  MISC_FEATURE (1)..(1): N-terminal acetylation
  MISC_FEATURE (20)..(20): C-terminal amidation
EQYVSAGWYDYNTDTYYEFE

SEQ ID NO: 824 - protein, 20 aa, Artificial Sequence
  Synthetic peptide
  MISC_FEATURE (1)..(1): N-terminal acetylation
  MISC_FEATURE (20)..(20): C-terminal amidation
EYQVSAGWYDYNTDTYYEFE

SEQ ID NO: 825 - protein, 20 aa, Artificial Sequence
  Synthetic peptide
  MISC_FEATURE (1)..(1): N-terminal acetylation
  MISC_FEATURE (20)..(20): C-terminal amidation
EYYQSAGWYDYNTDTYYEFE

SEQ ID NO: 826 - protein, 20 aa, Artificial Sequence
  Synthetic peptide
  MISC_FEATURE (1)..(1): N-terminal acetylation
  MISC_FEATURE (20)..(20): C-terminal amidation
EYYVQAGWYDYNTDTYYEFE

SEQ ID NO: 827 - protein, 20 aa, Artificial Sequence
  Synthetic peptide
  MISC_FEATURE (1)..(1): N-terminal acetylation
  MISC_FEATURE (20)..(20): C-terminal amidation
EYYVSQGWYDYNTDTYYEFE

SEQ ID NO: 828 - protein, 20 aa, Artificial Sequence
  Synthetic peptide
  MISC_FEATURE (1)..(1): N-terminal acetylation
  MISC_FEATURE (20)..(20): C-terminal amidation
EYYVSAQWYDYNTDTYYEFE

SEQ ID NO: 829 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGQYDYNTDTYYEFE

SEQ ID NO: 830 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWQDYNTDTYYEFE

SEQ ID NO: 831 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYQYNTDTYYEFE

SEQ ID NO: 832 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDQNTDTYYEFE

SEQ ID NO: 833 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYQTDTYYEFE

SEQ ID NO: 834 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNQDTYYEFE

SEQ ID NO: 835 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTQTYYEFE

SEQ ID NO: 836 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTDQYYEFE

SEQ ID NO: 837 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTDTQYEFE

SEQ ID NO: 838 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTDTYQEFE

SEQ ID NO: 839 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTDTYYQFE

SEQ ID NO: 840 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTDTYYEQE

SEQ ID NO: 841 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTDTYYEFQ

SEQ ID NO: 842 - protein, 20 aa, Artificial Sequence
  Synthetic peptide
  MISC_FEATURE (1)..(1): N-terminal acetylation
  MISC_FEATURE (20)..(20): C-terminal amidation
RYYVSAGWYDYNTDTYYEFE

SEQ ID NO: 843 - protein, 20 aa, Artificial Sequence
  Synthetic peptide
  MISC_FEATURE (1)..(1): N-terminal acetylation
  MISC_FEATURE (20)..(20): C-terminal amidation
ERYVSAGWYDYNTDTYYEFE

SEQ ID NO: 844 - protein, 20 aa, Artificial Sequence
  Synthetic peptide
  MISC_FEATURE (1)..(1): N-terminal acetylation
  MISC_FEATURE (20)..(20): C-terminal amidation
EYRVSAGWYDYNTDTYYEFE

SEQ ID NO: 845 - protein, 20 aa, Artificial Sequence
  Synthetic peptide
  MISC_FEATURE (1)..(1): N-terminal acetylation
  MISC_FEATURE (20)..(20): C-terminal amidation
EYYRSAGWYDYNTDTYYEFE

SEQ ID NO: 846 - protein, 20 aa, Artificial Sequence
  Synthetic peptide
  MISC_FEATURE (1)..(1): N-terminal acetylation
  MISC_FEATURE (20)..(20): C-terminal amidation
EYYVRAGWYDYNTDTYYEFE

SEQ ID NO: 847 - protein, 20 aa, Artificial Sequence
  Synthetic peptide
  MISC_FEATURE (1)..(1): N-terminal acetylation
  MISC_FEATURE (20)..(20): C-terminal amidation
EYYVSRGWYDYNTDTYYEFE

SEQ ID NO: 848 - protein, 20 aa, Artificial Sequence
  Synthetic peptide
  MISC_FEATURE (1)..(1): N-terminal acetylation
  MISC_FEATURE (20)..(20): C-terminal amidation
EYYVSARWYDYNTDTYYEFE

SEQ ID NO: 849 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGRYDYNTDTYYEFE

SEQ ID NO: 850 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWRDYNTDTYYEFE

SEQ ID NO: 851 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYRYNTDTYYEFE

SEQ ID NO: 852 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDRNTDTYYEFE

SEQ ID NO: 853 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYRTDTYYEFE

SEQ ID NO: 854 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNRDTYYEFE

SEQ ID NO: 855 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTRTYYEFE

SEQ ID NO: 856 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTDRYYEFE

SEQ ID NO: 857 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTDTRYEFE

SEQ ID NO: 858 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTDTYREFE

SEQ ID NO: 859 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTDTYYRFE

SEQ ID NO: 860 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTDTYYERE

SEQ ID NO: 861 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTDTYYEFR

SEQ ID NO: 862 - protein, 20 aa, Artificial Sequence
  Synthetic peptide
  MISC_FEATURE (1)..(1): N-terminal acetylation
  MISC_FEATURE (20)..(20): C-terminal amidation
SYYVSAGWYDYNTDTYYEFE

SEQ ID NO: 863 - protein, 20 aa, Artificial Sequence
  Synthetic peptide
  MISC_FEATURE (1)..(1): N-terminal acetylation
  MISC_FEATURE (20)..(20): C-terminal amidation
ESYVSAGWYDYNTDTYYEFE

SEQ ID NO: 864 - protein, 20 aa, Artificial Sequence
  Synthetic peptide
  MISC_FEATURE (1)..(1): N-terminal acetylation
  MISC_FEATURE (20)..(20): C-terminal amidation
EYSVSAGWYDYNTDTYYEFE

SEQ ID NO: 865 - protein, 20 aa, Artificial Sequence
  Synthetic peptide
  MISC_FEATURE (1)..(1): N-terminal acetylation
  MISC_FEATURE (20)..(20): C-terminal amidation
EYYSSAGWYDYNTDTYYEFE

SEQ ID NO: 866 - protein, 20 aa, Artificial Sequence
  Synthetic peptide
  MISC_FEATURE (1)..(1): N-terminal acetylation
  MISC_FEATURE (20)..(20): C-terminal amidation
EYYVSSGWYDYNTDTYYEFE

SEQ ID NO: 867 - protein, 20 aa, Artificial Sequence
  Synthetic peptide
  MISC_FEATURE (1)..(1): N-terminal acetylation
  MISC_FEATURE (20)..(20): C-terminal amidation
EYYVSASWYDYNTDTYYEFE

SEQ ID NO: 868 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGSYDYNTDTYYEFE

SEQ ID NO: 869 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWSDYNTDTYYEFE

SEQ ID NO: 870 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYSYNTDTYYEFE

SEQ ID NO: 871 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDSNTDTYYEFE

SEQ ID NO: 872 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYSTDTYYEFE

SEQ ID NO: 873 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNSDTYYEFE

SEQ ID NO: 874 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTSTYYEFE

SEQ ID NO: 875 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTDSYYEFE

SEQ ID NO: 876 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTDTSYEFE

SEQ ID NO: 877 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTDTYSEFE

SEQ ID NO: 878 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTDTYYSFE

SEQ ID NO: 879 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTDTYYESE

SEQ ID NO: 880 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTDTYYEFS

SEQ ID NO: 881 - protein, 20 aa, Artificial Sequence
  Synthetic peptide
  MISC_FEATURE (1)..(1): N-terminal acetylation
  MISC_FEATURE (20)..(20): C-terminal amidation
TYYVSAGWYDYNTDTYYEFE

SEQ ID NO: 882 - protein, 20 aa, Artificial Sequence
  Synthetic peptide
  MISC_FEATURE (1)..(1): N-terminal acetylation
  MISC_FEATURE (20)..(20): C-terminal amidation
ETYVSAGWYDYNTDTYYEFE

SEQ ID NO: 883 - protein, 20 aa, Artificial Sequence
  Synthetic peptide
  MISC_FEATURE (1)..(1): N-terminal acetylation
  MISC_FEATURE (20)..(20): C-terminal amidation
EYTVSAGWYDYNTDTYYEFE

SEQ ID NO: 884 - protein, 20 aa, Artificial Sequence
  Synthetic peptide
  MISC_FEATURE (1)..(1): N-terminal acetylation
  MISC_FEATURE (20)..(20): C-terminal amidation
EYYTSAGWYDYNTDTYYEFE

SEQ ID NO: 885 - protein, 20 aa, Artificial Sequence
  Synthetic peptide
  MISC_FEATURE (1)..(1): N-terminal acetylation
  MISC_FEATURE (20)..(20): C-terminal amidation
EYYVSTGWYDYNTDTYYEFE

SEQ ID NO: 886 - protein, 20 aa, Artificial Sequence
  Synthetic peptide
  MISC_FEATURE (1)..(1): N-terminal acetylation
  MISC_FEATURE (20)..(20): C-terminal amidation
EYYVSATWYDYNTDTYYEFE

SEQ ID NO: 887 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGTYDYNTDTYYEFE

SEQ ID NO: 888 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWTDYNTDTYYEFE

SEQ ID NO: 889 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYTYNTDTYYEFE

SEQ ID NO: 890 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDTNTDTYYEFE

SEQ ID NO: 891 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYTTDTYYEFE

SEQ ID NO: 892 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTTTYYEFE

SEQ ID NO: 893 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTDTTYEFE

SEQ ID NO: 894 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTDTYTEFE

SEQ ID NO: 895 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTDTYYTFE

SEQ ID NO: 896 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTDTYYETE

SEQ ID NO: 897 - protein, 20 aa, Artificial Sequence
  Synthetic peptide
  MISC_FEATURE (1)..(1): N-terminal acetylation
  MISC_FEATURE (20)..(20): C-terminal amidation
VYYVSAGWYDYNTDTYYEFE

SEQ ID NO: 898 - protein, 20 aa, Artificial Sequence
  Synthetic peptide
  MISC_FEATURE (1)..(1): N-terminal acetylation
  MISC_FEATURE (20)..(20): C-terminal amidation
EVYVSAGWYDYNTDTYYEFE

SEQ ID NO: 899 - protein, 20 aa, Artificial Sequence
  Synthetic peptide
  MISC_FEATURE (1)..(1): N-terminal acetylation
  MISC_FEATURE (20)..(20): C-terminal amidation
EYVVSAGWYDYNTDTYYEFE

SEQ ID NO: 900 - protein, 20 aa, Artificial Sequence
  Synthetic peptide
  MISC_FEATURE (1)..(1): N-terminal acetylation
  MISC_FEATURE (20)..(20): C-terminal amidation
EYYVVAGWYDYNTDTYYEFE

SEQ ID NO: 901 - protein, 20 aa, Artificial Sequence
  Synthetic peptide
  MISC_FEATURE (1)..(1): N-terminal acetylation
  MISC_FEATURE (20)..(20): C-terminal amidation
EYYVSVGWYDYNTDTYYEFE

SEQ ID NO: 902 - protein, 20 aa, Artificial Sequence
  Synthetic peptide
  MISC_FEATURE (1)..(1): N-terminal acetylation
  MISC_FEATURE (20)..(20): C-terminal amidation
EYYVSAVWYDYNTDTYYEFE

SEQ ID NO: 903 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGVYDYNTDTYYEFE

SEQ ID NO: 904 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWVDYNTDTYYEFE

SEQ ID NO: 905 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYVYNTDTYYEFE

SEQ ID NO: 906 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDVNTDTYYEFE

SEQ ID NO: 907 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYVTDTYYEFE

SEQ ID NO: 908 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNVDTYYEFE

SEQ ID NO: 909 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTVTYYEFE

SEQ ID NO: 910 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTDVYYEFE

SEQ ID NO: 911 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTDTVYEFE

SEQ ID NO: 912 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTDTYVEFE

SEQ ID NO: 913 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTDTYYVFE

SEQ ID NO: 914 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTDTYYEVE

SEQ ID NO: 915 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTDTYYEFV

SEQ ID NO: 916 - protein, 20 aa, Artificial Sequence
  Synthetic peptide
  MISC_FEATURE (1)..(1): N-terminal acetylation
  MISC_FEATURE (20)..(20): C-terminal amidation
WYYVSAGWYDYNTDTYYEFE

SEQ ID NO: 917 - protein, 20 aa, Artificial Sequence
  Synthetic peptide
  MISC_FEATURE (1)..(1): N-terminal acetylation
  MISC_FEATURE (20)..(20): C-terminal amidation
EWYVSAGWYDYNTDTYYEFE

SEQ ID NO: 918 - protein, 20 aa, Artificial Sequence
  Synthetic peptide
  MISC_FEATURE (1)..(1): N-terminal acetylation
  MISC_FEATURE (20)..(20): C-terminal amidation
EYWVSAGWYDYNTDTYYEFE

SEQ ID NO: 919 - protein, 20 aa, Artificial Sequence
  Synthetic peptide
  MISC_FEATURE (1)..(1): N-terminal acetylation
  MISC_FEATURE (20)..(20): C-terminal amidation
EYYWSAGWYDYNTDTYYEFE

SEQ ID NO: 920 - protein, 20 aa, Artificial Sequence
  Synthetic peptide
  MISC_FEATURE (1)..(1): N-terminal acetylation
  MISC_FEATURE (20)..(20): C-terminal amidation
EYYVWAGWYDYNTDTYYEFE

SEQ ID NO: 921 - protein, 20 aa, Artificial Sequence
  Synthetic peptide
  MISC_FEATURE (1)..(1): N-terminal acetylation
  MISC_FEATURE (20)..(20): C-terminal amidation
EYYVSWGWYDYNTDTYYEFE

SEQ ID NO: 922 - protein, 20 aa, Artificial Sequence
  Synthetic peptide
  MISC_FEATURE (1)..(1): N-terminal acetylation
  MISC_FEATURE (20)..(20): C-terminal amidation
EYYVSAWWYDYNTDTYYEFE

SEQ ID NO: 923 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWWDYNTDTYYEFE

SEQ ID NO: 924 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYWYNTDTYYEFE

SEQ ID NO: 925 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDWNTDTYYEFE

SEQ ID NO: 926 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYWTDTYYEFE

SEQ ID NO: 927 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNWDTYYEFE

SEQ ID NO: 928 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTWTYYEFE

SEQ ID NO: 929 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTDWYYEFE

SEQ ID NO: 930 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTDTWYEFE

SEQ ID NO: 931 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTDTYWEFE

SEQ ID NO: 932 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTDTYYWFE

SEQ ID NO: 933 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTDTYYEWE

SEQ ID NO: 934 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTDTYYEFW

SEQ ID NO: 935 - protein, 20 aa, Artificial Sequence
  Synthetic peptide
  MISC_FEATURE (1)..(1): N-terminal acetylation
  MISC_FEATURE (20)..(20): C-terminal amidation
YYYVSAGWYDYNTDTYYEFE

SEQ ID NO: 936 - protein, 20 aa, Artificial Sequence
  Synthetic peptide
  MISC_FEATURE (1)..(1): N-terminal acetylation
  MISC_FEATURE (20)..(20): C-terminal amidation
EYYYSAGWYDYNTDTYYEFE

SEQ ID NO: 937 - protein, 20 aa, Artificial Sequence
  Synthetic peptide
  MISC_FEATURE (1)..(1): N-terminal acetylation
  MISC_FEATURE (20)..(20): C-terminal amidation
EYYVYAGWYDYNTDTYYEFE

SEQ ID NO: 938 - protein, 20 aa, Artificial Sequence
  Synthetic peptide
  MISC_FEATURE (1)..(1): N-terminal acetylation
  MISC_FEATURE (20)..(20): C-terminal amidation
EYYVSYGWYDYNTDTYYEFE

SEQ ID NO: 939 - protein, 20 aa, Artificial Sequence
  Synthetic peptide
  MISC_FEATURE (1)..(1): N-terminal acetylation
  MISC_FEATURE (20)..(20): C-terminal amidation
EYYVSAYWYDYNTDTYYEFE

SEQ ID NO: 940 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGYYDYNTDTYYEFE

SEQ ID NO: 941 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYYYNTDTYYEFE

SEQ ID NO: 942 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYYTDTYYEFE

SEQ ID NO: 943 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNYDTYYEFE

SEQ ID NO: 944 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTYTYYEFE

SEQ ID NO: 945 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTDYYYEFE

SEQ ID NO: 946 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTDTYYYFE

SEQ ID NO: 947 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTDTYYEYE

SEQ ID NO: 948 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTDTYYEFY

SEQ ID NO: 949 - protein, 20 aa, Artificial Sequence
  Synthetic peptide
  MISC_FEATURE (1)..(1): N-terminal acetylation
  MISC_FEATURE (1)..(1): D-Glu
  MISC_FEATURE (20)..(20): C-terminal amidation
EYYVSAGWYDYNTDTYYEFE

SEQ ID NO: 950 - protein, 20 aa, Artificial Sequence
  Synthetic peptide
  MISC_FEATURE (1)..(1): N-terminal acetylation
  MISC_FEATURE (2)..(2): D-Tyr
  MISC_FEATURE (20)..(20): C-terminal amidation
EYYVSAGWYDYNTDTYYEFE

SEQ ID NO: 951 - protein, 20 aa, Artificial Sequence
  Synthetic peptide
  MISC_FEATURE (1)..(1): N-terminal acetylation
  MISC_FEATURE (3)..(3): D-Tyr
  MISC_FEATURE (20)..(20): C-terminal amidation
EYYVSAGWYDYNTDTYYEFE

SEQ ID NO: 952 - protein, 20 aa, Artificial Sequence
  Synthetic peptide
  MISC_FEATURE (1)..(1): N-terminal acetylation
  MISC_FEATURE (4)..(4): D-Val
  MISC_FEATURE (20)..(20): C-terminal amidation
EYYVSAGWYDYNTDTYYEFE

SEQ ID NO: 953 - protein, 20 aa, Artificial Sequence
  Synthetic peptide
  MISC_FEATURE (1)..(1): N-terminal acetylation
  MISC_FEATURE (5)..(5): D-Ser
  MISC_FEATURE (20)..(20): C-terminal amidation
EYYVSAGWYDYNTDTYYEFE

SEQ ID NO: 954 - protein, 20 aa, Artificial Sequence
  Synthetic peptide
  MISC_FEATURE (1)..(1): N-terminal acetylation
  MISC_FEATURE (6)..(6): D-Ala
  MISC_FEATURE (20)..(20): C-terminal amidation
EYYVSAGWYDYNTDTYYEFE

SEQ ID NO: 955 - protein, 20 aa, Artificial Sequence
  Synthetic peptide
  MISC_FEATURE (1)..(1): N-terminal acetylation
  MISC_FEATURE (7)..(7): D-Ala
  MISC_FEATURE (20)..(20): C-terminal amidation
EYYVSAAWYDYNTDTYYEFE

SEQ ID NO: 956 - protein, 20 aa, Artificial Sequence
  Synthetic peptide
  MISC_FEATURE (1)..(1): N-terminal acetylation
  MISC_FEATURE (8)..(8): D-Trp
  MISC_FEATURE (20)..(20): C-terminal amidation
EYYVSAGWYDYNTDTYYEFE

SEQ ID NO: 957 - protein, 20 aa, Artificial Sequence
  Synthetic peptide
  MISC_FEATURE (1)..(1): N-terminal acetylation
  MISC_FEATURE (9)..(9): D-Tyr
  MISC_FEATURE (20)..(20): C-terminal amidation
EYYVSAGWYDYNTDTYYEFE

SEQ ID NO: 958 - protein, 20 aa, Artificial Sequence
  Synthetic peptide
  MISC_FEATURE (1)..(1): N-terminal acetylation
  MISC_FEATURE (10)..(10): D-Asp
  MISC_FEATURE (20)..(20): C-terminal amidation
EYYVSAGWYDYNTDTYYEFE

SEQ ID NO: 959 - protein, 20 aa, Artificial Sequence
  Synthetic peptide
  MISC_FEATURE (1)..(1): N-terminal acetylation
  MISC_FEATURE (11)..(11): D-Tyr
  MISC_FEATURE (20)..(20): C-terminal amidation
EYYVSAGWYDYNTDTYYEFE

SEQ ID NO: 960 - protein, 20 aa, Artificial Sequence
  Synthetic peptide
  MISC_FEATURE (1)..(1): N-terminal acetylation
  MISC_FEATURE (12)..(12): D-Asn
  MISC_FEATURE (20)..(20): C-terminal amidation
EYYVSAGWYDYNTDTYYEFE

SEQ ID NO: 961 - protein, 20 aa, Artificial Sequence
  Synthetic peptide
  MISC_FEATURE (1)..(1): N-terminal acetylation
  MISC_FEATURE (20)..(20): C-terminal amidation
EYYVSAGWYDYNTDTYYEFE

SEQ ID NO: 962 - protein, 20 aa, Artificial Sequence
  Synthetic peptide
  MISC_FEATURE (1)..(1): N-terminal acetylation
  MISC_FEATURE (14)..(14): D-Asp
  MISC_FEATURE (20)..(20): C-terminal amidation
EYYVSAGWYDYNTDTYYEFE

SEQ ID NO: 963 - protein, 20 aa, Artificial Sequence
  Synthetic peptide
  MISC_FEATURE (1)..(1): N-terminal acetylation
  MISC_FEATURE (15)..(15): D-Thr
  MISC_FEATURE (20)..(20): C-terminal amidation
EYYVSAGWYDYNTDTYYEFE

SEQ ID NO: 964 - protein, 20 aa, Artificial Sequence
  Synthetic peptide
  MISC_FEATURE (1)..(1): N-terminal acetylation
  MISC_FEATURE (16)..(16): D-Tyr
  MISC_FEATURE (20)..(20): C-terminal amidation
EYYVSAGWYDYNTDTYYEFE

SEQ ID NO: 965 - protein, 20 aa, Artificial Sequence
  Synthetic peptide
  MISC_FEATURE (1)..(1): N-terminal acetylation
  MISC_FEATURE (17)..(17): D-Tyr
  MISC_FEATURE (20)..(20): C-terminal amidation
EYYVSAGWYDYNTDTYYEFE

SEQ ID NO: 966 - protein, 20 aa, Artificial Sequence
  Synthetic peptide
  MISC_FEATURE (1)..(1): N-terminal acetylation
  MISC_FEATURE (17)..(17): D-Glu
  MISC_FEATURE (20)..(20): C-terminal amidation
EYYVSAGWYDYNTDTYYEFE

SEQ ID NO: 967 - protein, 20 aa, Artificial Sequence
  Synthetic peptide
  MISC_FEATURE (1)..(1): N-terminal acetylation
  MISC_FEATURE (18)..(18): D-Phe
  MISC_FEATURE (20)..(20): C-terminal amidation
EYYVSAGWYDYNTDTYYEFE

SEQ ID NO: 968 - protein, 20 aa, Artificial Sequence
  Synthetic peptide
  MISC_FEATURE (1)..(1): N-terminal acetylation
  MISC_FEATURE (20)..(20): D-Glu
  MISC_FEATURE (20)..(20): C-terminal amidation
EYYVSAGWYDYNTDTYYEFE

SEQ ID NO: 969 - protein, 20 aa, Artificial Sequence
  Synthetic peptide
  MISC_FEATURE (1)..(1): N-terminal acetylation
  MISC_FEATURE (1)..(1): D-Pro
  MISC_FEATURE (20)..(20): C-terminal amidation
PYYVSAGWYDYNTDTYYEFE

SEQ ID NO: 970 - protein, 20 aa, Artificial Sequence
  Synthetic peptide
  MISC_FEATURE (1)..(1): N-terminal acetylation
  MISC_FEATURE (2)..(2): D-Pro
  MISC_FEATURE (20)..(20): C-terminal amidation
EPYVSAGWYDYNTDTYYEFE

SEQ ID NO: 971 - protein, 20 aa, Artificial Sequence
  Synthetic peptide
  MISC_FEATURE (1)..(1): N-terminal acetylation
  MISC_FEATURE (3)..(3): D-Pro
  MISC_FEATURE (20)..(20): C-terminal amidation
EYPVSAGWYDYNTDTYYEFE

SEQ ID NO: 972 - protein, 20 aa, Artificial Sequence
  Synthetic peptide
  MISC_FEATURE (1)..(1): N-terminal acetylation
  MISC_FEATURE (4)..(4): D-Pro
  MISC_FEATURE (20)..(20): C-terminal amidation
EYYPSAGWYDYNTDTYYEFE

SEQ ID NO: 973 - protein, 20 aa, Artificial Sequence
  Synthetic peptide
  MISC_FEATURE (1)..(1): N-terminal acetylation
  MISC_FEATURE (5)..(5): D-Pro
  MISC_FEATURE (20)..(20): C-terminal amidation
EYYVPAGWYDYNTDTYYEFE

SEQ ID NO: 974 - protein, 20 aa, Artificial Sequence
  Synthetic peptide
  MISC_FEATURE (1)..(1): N-terminal acetylation
  MISC_FEATURE (6)..(6): D-Pro
  MISC_FEATURE (20)..(20): C-terminal amidation
EYYVSPGWYDYNTDTYYEFE

SEQ ID NO: 975 - protein, 20 aa, Artificial Sequence
  Synthetic peptide
  MISC_FEATURE (1)..(1): N-terminal acetylation
  MISC_FEATURE (7)..(7): D-Pro
  MISC_FEATURE (20)..(20): C-terminal amidation
EYYVSAPWYDYNTDTYYEFE

SEQ ID NO: 976 - protein, 20 aa, Artificial Sequence
  Synthetic peptide
  MISC_FEATURE (1)..(1): N-terminal acetylation
  MISC_FEATURE (8)..(8): D-Pro
  MISC_FEATURE (20)..(20): C-terminal amidation
EYYVSAGPYDYNTDTYYEFE

SEQ ID NO: 977 - protein, 20 aa, Artificial Sequence
  Synthetic peptide
  MISC_FEATURE (1)..(1): N-terminal acetylation
  MISC_FEATURE (9)..(9): D-Pro
  MISC_FEATURE (20)..(20): C-terminal amidation
EYYVSAGWPDYNTDTYYEFE

SEQ ID NO: 978 - protein, 20 aa, Artificial Sequence
  Synthetic peptide
  MISC_FEATURE (1)..(1): N-terminal acetylation
  MISC_FEATURE (10)..(10): D-Pro
  MISC_FEATURE (20)..(20): C-terminal amidation
EYYVSAGWYPYNTDTYYEFE

SEQ ID NO: 979 - protein, 20 aa, Artificial Sequence
  Synthetic peptide
  MISC_FEATURE (1)..(1): N-terminal acetylation
  MISC_FEATURE (11)..(11): D-Pro
  MISC_FEATURE (20)..(20): C-terminal amidation
EYYVSAGWYDPNTDTYYEFE

SEQ ID NO: 980 - protein, 20 aa, Artificial Sequence
  Synthetic peptide
  MISC_FEATURE (1)..(1): N-terminal acetylation
  MISC_FEATURE (12)..(12): D-Pro
  MISC_FEATURE (20)..(20): C-terminal amidation
EYYVSAGWYDYPTDTYYEFE

SEQ ID NO: 981 - protein, 20 aa, Artificial Sequence
  Synthetic peptide
  MISC_FEATURE (1)..(1): N-terminal acetylation
  MISC_FEATURE (13)..(13): D-Pro
  MISC_FEATURE (20)..(20): C-terminal amidation
EYYVSAGWYDYNPDTYYEFE

SEQ ID NO: 982 - protein, 20 aa, Artificial Sequence
  Synthetic peptide
  MISC_FEATURE (1)..(1): N-terminal acetylation
  MISC_FEATURE (14)..(14): D-Pro
  MISC_FEATURE (20)..(20): C-terminal amidation
EYYVSAGWYDYNTPTYYEFE

SEQ ID NO: 983 - protein, 20 aa, Artificial Sequence
  Synthetic peptide
  MISC_FEATURE (1)..(1): N-terminal acetylation
  MISC_FEATURE (15)..(15): D-Pro
  MISC_FEATURE (20)..(20): C-terminal amidation
EYYVSAGWYDYNTDPYYEFE

SEQ ID NO: 984 - protein, 20 aa, Artificial Sequence
  Synthetic peptide
  MISC_FEATURE (1)..(1): N-terminal acetylation
  MISC_FEATURE (16)..(16): D-Pro
  MISC_FEATURE (20)..(20): C-terminal amidation
EYYVSAGWYDYNTDTPYEFE

SEQ ID NO: 985 - protein, 20 aa, Artificial Sequence
  Synthetic peptide
  MISC_FEATURE (1)..(1): N-terminal acetylation
  MISC_FEATURE (17)..(17): D-Pro
  MISC_FEATURE (20)..(20): C-terminal amidation
EYYVSAGWYDYNTDTYPEFE

SEQ ID NO: 986 - protein, 20 aa, Artificial Sequence
  Synthetic peptide
  MISC_FEATURE (1)..(1): N-terminal acetylation
  MISC_FEATURE (18)..(18): D-Pro
  MISC_FEATURE (20)..(20): C-terminal amidation
EYYVSAGWYDYNTDTYYPFE

SEQ ID NO: 987 - protein, 20 aa, Artificial Sequence
  Synthetic peptide
  MISC_FEATURE (1)..(1): N-terminal acetylation
  MISC_FEATURE (19)..(19): D-Pro
  MISC_FEATURE (20)..(20): C-terminal amidation
EYYVSAGWYDYNTDTYYEPE

SEQ ID NO: 988 - protein, 20 aa, Artificial Sequence
  Synthetic peptide
  MISC_FEATURE (1)..(1): N-terminal acetylation
  MISC_FEATURE (20)..(20): D-Pro
  MISC_FEATURE (20)..(20): C-terminal amidation
EYYVSAGWYDYNTDTYYEFP

SEQ ID NO: 989 - protein, 19 aa, Artificial Sequence
  Synthetic peptide
  MISC_FEATURE (1)..(1): N-terminal acetylation
  MISC_FEATURE (19)..(19): C-terminal amidation
YYVSAGWYDYNTDTYYEFE

SEQ ID NO: 990 - protein, 18 aa, Artificial Sequence
  Synthetic peptide
  MISC_FEATURE (1)..(1): N-terminal acetylation
  MISC_FEATURE (18)..(18): C-terminal amidation
YVSAGWYDYNTDTYYEFE

SEQ ID NO: 991 - protein, 17 aa, Artificial Sequence
  Synthetic peptide
  MISC_FEATURE (1)..(1): N-terminal acetylation
  MISC_FEATURE (17)..(17): C-terminal amidation
VSAGWYDYNTDTYYEFE

SEQ ID NO: 992 - protein, 16 aa, Artificial Sequence
  Synthetic peptide
  MISC_FEATURE (1)..(1): N-terminal acetylation
  MISC_FEATURE (16)..(16): C-terminal amidation
SAGWYDYNTDTYYEFE

SEQ ID NO: 993 - protein, 18 aa, Artificial Sequence
  Synthetic peptide
  MISC_FEATURE (1)..(1): N-terminal acetylation
  MISC_FEATURE (18)..(18): C-terminal amidation
EYYVSAGWYDYNTDTYYE

SEQ ID NO: 994 - protein, 17 aa, Artificial Sequence
  Synthetic peptide
  MISC_FEATURE (1)..(1): N-terminal acetylation
  MISC_FEATURE (17)..(17): C-terminal amidation
EYYVSAGWYDYNTDTYY

SEQ ID NO: 995 - protein, 17 aa, Artificial Sequence
  Synthetic peptide
  MISC_FEATURE (1)..(1): N-terminal acetylation
  MISC_FEATURE (17)..(17): C-terminal amidation
YVSAGWYDYNTDTYYEF

SEQ ID NO: 996 - protein, 15 aa, Artificial Sequence
  Synthetic peptide
  MISC_FEATURE (1)..(1): N-terminal acetylation
  MISC_FEATURE (15)..(15): C-terminal amidation
VSAGWYDYNTDTYYE

SEQ ID NO: 997 - protein, 13 aa, Artificial Sequence
  Synthetic peptide
  MISC_FEATURE (1)..(1): N-terminal acetylation
  MISC_FEATURE (13)..(13): C-terminal amidation
SAGWYDYNTDTYY

SEQ ID NO: 998 - protein, 11 aa, Artificial Sequence
  Synthetic peptide
  MISC_FEATURE (1)..(1): N-terminal acetylation
  MISC_FEATURE (11)..(11): C-terminal amidation
AGWYDYNTDTY

SEQ ID NO: 999 - protein, 21 aa, Artificial Sequence
  Synthetic peptide
  MISC_FEATURE (1)..(1): N-terminal acetylation
  MISC_FEATURE (21)..(21): Side chain amino group of Lys covalently bound to human serum albumin (HSA) via reaction of Cysteine-sidechain in HSA with Mal-Ttds
  MISC_FEATURE (21)..(21): C-terminal amidation
EYYVSAGWYDYNTDTYYEFEK

SEQ ID NO: 1000 - protein, 21 aa, Artificial Sequence
  Synthetic peptide
  MISC_FEATURE (1)..(1): N-terminus modified with 20kDa methoxy PEG via amino hexanoic acid (Ahx)
  MISC_FEATURE (21)..(21): Covalently bound to 20kDa methoxy PEG
  MISC_FEATURE (21)..(21): C-terminal amidation
EYYVSAGWYDYNTDTYYEFEK

SEQ ID NO: 1001 - protein, 21 aa, Artificial Sequence
  Synthetic peptide
  MISC_FEATURE (1)..(1): N-terminus modified with 20kDa methoxy PEG bound to amino hexanoic acid (Ahx) via glutaric acid linker
  MISC_FEATURE (21)..(21): Covalently bound to 20kDa methoxy PEG via glutaric acid linker
  MISC_FEATURE (21)..(21): C-terminal amidation
EYYVSAGWYDYNTDTYYEFEK

SEQ ID NO: 1002 - protein, 21 aa, Artificial Sequence
  Synthetic peptide
  MISC_FEATURE (1)..(1): N-terminus modified with branched 20kDa PEG bound to amino hexanoix acid via glutaric acid linker
  MISC_FEATURE (22)..(22): Covalently bound to branched 20kDa PEG via glutaric acid linker
  MISC_FEATURE (22)..(22): C-terminal amidation
EYYVSAGWYDYNTDTYYEFEK

SEQ ID NO: 1003 - protein, 21 aa, Artificial Sequence
  Synthetic peptide
  MISC_FEATURE (1)..(1): N-terminal acetylation
  MISC_FEATURE (21)..(21): Epsilon amine bound to Ttds which is bound to octadecanedioyl via gamma-Glu
  MISC_FEATURE (21)..(21): C-terminal amidation
EYYVSAGWYDYNTDTYYEFEK

SEQ ID NO: 1004 - protein, 21 aa, Artificial Sequence
  Synthetic peptide
  MISC_FEATURE (1)..(1): N-terminus modified with glutaric acid via amino hexanoic acid
  MISC_FEATURE (22)..(22): Covalently bound to glutaric acid
  MISC_FEATURE (22)..(22): C-terminal amidation
EYYVSAGWYDYNTDTYYEFEK

SEQ ID NO: 1005 - protein, 21 aa, Artificial Sequence
  Synthetic peptide
  MISC_FEATURE (1)..(1): N-terminal acetylation
  MISC_FEATURE (21)..(21): Side chain amino group of Lys covalently bound to mouse serum albumin (MSA) via reaction of Cysteine-sidechain in MSA with Mal-Ttds
  MISC_FEATURE (21)..(21): C-terminal amidation
EYYVSAGWYDYNTDTYYEFEK

SEQ ID NO: 1006 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  DISULFID (8)..(21): Cys residues linked via disulfide bond
  MISC_FEATURE (21)..(21): C-terminal amidation
XVLSWSVCYLQQEAYRSTTIC

SEQ ID NO: 1007 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  DISULFID (10)..(20): Cys residues linked via disulfide bond
  MISC_FEATURE (21)..(21): C-terminal amidation
XRGLEEQETCVRVSSRVEICW

SEQ ID NO: 1008 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  DISULFID (4)..(14): Cys residues linked via disulfide bond
  MISC_FEATURE (21)..(21): C-terminal amidation
XNWCIAISPTMDLCLYLRKEN

SEQ ID NO: 1009 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  DISULFID (6)..(16): Cys residues linked via disulfide bond
  MISC_FEATURE (21)..(21): C-terminal amidation
XLDDMCYALTEHVSICYGAAS

SEQ ID NO: 1010 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  DISULFID (6)..(16): Cys residues linked via disulfide bond
  MISC_FEATURE (21)..(21): C-terminal amidation
XRREMCHALGGMVTVCVGWEW

SEQ ID NO: 1011 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  DISULFID (8)..(18): Cys residues linked via disulfide bond
  MISC_FEATURE (21)..(21): C-terminal amidation
XVFQKEECVLATESVWVCWGN

SEQ ID NO: 1012 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  DISULFID (5)..(15): Cys residues linked via disulfide bond
  MISC_FEATURE (21)..(21): C-terminal amidation
XWEVCVPLSAGGMICVGRTDR

SEQ ID NO: 1013 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  DISULFID (5)..(12): Cys residues linked via disulfide bond
  MISC_FEATURE (21)..(21): C-terminal amidation
XVWLCLEETGLCVQVLGAARF

SEQ ID NO: 1014 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XANKMLGSSGPWYWIEVGWSS

SEQ ID NO: 1015 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XGGSLSIHIDWGWAPSSRWTH

SEQ ID NO: 1016 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XWRHGAIQWGWSESSRYRHSL

SEQ ID NO: 1017 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XWFGWTWGLTRSSEYQHSGNK

SEQ ID NO: 1018 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XGRNVKRSYWGVVDWGWEESS

SEQ ID NO: 1019 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XGLGWEVGWHVLESSHDLTIH

SEQ ID NO: 1020 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XYYVAVGWYRITTGESMWMMV

SEQ ID NO: 1021 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XYSVQVGWYMDASHYQHAMRH

SEQ ID NO: 1022 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XVIRVGWYNRVSGQIMWVGLI

SEQ ID NO: 1023 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XWVLGWYDKALETEYDYMYGG

SEQ ID NO: 1024 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XVEVGWYLVDRDVWMLWSDHE

SEQ ID NO: 1025 - protein, 20 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (20)..(20): C-terminal amidation
XGWFMEVATVLGVIEVGWVV

SEQ ID NO: 1026 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XMWIGWHTVSEESDHWFAWVT

SEQ ID NO: 1027 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XWENETLLRLPSGAMVWVGFT

SEQ ID NO: 1028 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XRLGIQLWGATLSQEWLVWEL

SEQ ID NO: 1029 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XNYVRTEVLWENEVVGVWLEW

SEQ ID NO: 1030 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XGLSWHLYLGNGGTVTIGYET

SEQ ID NO: 1031 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XSLGHVHMGRRYTVELRWERA

SEQ ID NO: 1032 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XELPLALQGMESHGIVSWGWA

SEQ ID NO: 1033 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XFGSEWQIWILLDSGDEYMLG

SEQ ID NO: 1034 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XIFGVIETFAGTVSFGWEWYD

SEQ ID NO: 1035 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XKDNEELVLMRGRLEIWLGME

SEQ ID NO: 1036 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XRPTTLIRLGANSWIEIGWEI

SEQ ID NO: 1037 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XYILWSVYVGPGIEVGWTESA

SEQ ID NO: 1038 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XWKVWRLGGVELWYKEFGSER

SEQ ID NO: 1039 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XREREFRINFYVSWGWEPSGI

SEQ ID NO: 1040 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XLRKRLTNLDSIFVVELWWEY

SEQ ID NO: 1041 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XWWVTNNVMVGWEFVQPGEPT

SEQ ID NO: 1042 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XHEQTVTLWYHHRETGVDYRS

SEQ ID NO: 1043 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XGRWKSGESTWTVELFWVWNG

SEQ ID NO: 1044 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XVEWELWVEWVVEGQEVRVKL

SEQ ID NO: 1045 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XWMVKFSVVRGITEVGWEVLD

SEQ ID NO: 1046 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XGFAIWIGLIKGHHSYEWELR

SEQ ID NO: 1047 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XESTIEFWIEGKLVPEFIFTY

SEQ ID NO: 1048 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XHLYLWQRWPSPWVEVGWEFV

SEQ ID NO: 1049 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  DISULFID (8)..(19): Cys residues linked via disulfide bond
  MISC_FEATURE (21)..(21): C-terminal amidation
XGSTVQVCWYWEEVEVETCVS

SEQ ID NO: 1050 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  DISULFID (9)..(18): Cys residues linked via disulfide bond
  MISC_FEATURE (21)..(21): C-terminal amidation
XGNAKVWLCVEDKHMTVCTLI

SEQ ID NO: 1051 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XDLDPRIVLVGNGEIEIGWSI

SEQ ID NO: 1052 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XDQVWWWGPKARMGLIEYGWE

SEQ ID NO: 1053 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XNQGYTHNTKLRFYVELGWEH

SEQ ID NO: 1054 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XWIEVGWFEANTGRHRTWTIV

SEQ ID NO: 1055 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XIWVGWEDVRRGRILEEITWK

SEQ ID NO: 1056 - protein, 20 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (20)..(20): C-terminal amidation
XKYLLLDFTFWLTKEVGVGW

SEQ ID NO: 1057 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XVWVGWTERRGSKEQVLWEVK

SEQ ID NO: 1058 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XEVRYRFEGIPFFHVIFGWEF

SEQ ID NO: 1059 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XYSVLVWRAGGGQVELWMSRV

SEQ ID NO: 1060 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XPIWERDSVPRWMYSIELYWE

SEQ ID NO: 1061 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XWRWSIVVGYQWKGTDHDLWA

SEQ ID NO: 1062 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XVYEVGWDHGNWYEIIWRYPS

SEQ ID NO: 1063 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XWFQREYEIKKGQIWLVIRVG

SEQ ID NO: 1064 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XQVWVGYYNTIEDTELVMWTV

SEQ ID NO: 1065 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XRIWIGMYLGGTLTWEWEVIP

SEQ ID NO: 1066 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XYSEITIGVYWEQYSYDFYNF

SEQ ID NO: 1067 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XVVRHWHYVGMEFGFEKVREV

SEQ ID NO: 1068 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  DISULFID (5)..(15): Cys residues linked via disulfide bond
  MISC_FEATURE (21)..(21): C-terminal amidation
XGESCVRINHKVWVCWDMGSE

SEQ ID NO: 1069 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  DISULFID (10)..(20): Cys residues linked via disulfide bond
  MISC_FEATURE (21)..(21): C-terminal amidation
XYERGTFHTCSRYDERIDVCW

SEQ ID NO: 1070 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  DISULFID (6)..(20): Cys residues linked via disulfide bond
  MISC_FEATURE (21)..(21): C-terminal amidation
XGVIVCYTHTSSWHGHNDWCY

SEQ ID NO: 1071 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  DISULFID (16)..(19): Cys residues linked via disulfide bond
  MISC_FEATURE (21)..(21): C-terminal amidation
XSHRKSQLHQQYRSRCERCSN

SEQ ID NO: 1072 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XLVRVRLTQFAQYSRRSGVAF

SEQ ID NO: 1073 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XSSWNGQRAWMLVGMRGVAVN

SEQ ID NO: 1074 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XGVPGLKSRYSEGLSLDTSWL

SEQ ID NO: 1075 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XSVEASDLNFYFVMSAWSKII

SEQ ID NO: 1076 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XTLEGRRVILVRMVWRWTYHV

SEQ ID NO: 1077 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XKWFTITRFATLHTSYIFIQN

SEQ ID NO: 1078 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XNRIHLSWGTKNQGFTKLKRI

SEQ ID NO: 1079 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XQAIKGRIHGDIESDRYSVYY

SEQ ID NO: 1080 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XAGIQLVLEWYGHRVIVIQLG

SEQ ID NO: 1081 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XVYADINMLASITWFARPYMD

SEQ ID NO: 1082 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XFIWIVLMPRRGTPKREWAYY

SEQ ID NO: 1083 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XWSRLLARVVWKSGTIEVGWA

SEQ ID NO: 1084 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XGYWTVEFWVQWSGGDDVLIR

SEQ ID NO: 1085 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XEDVGKFKWYIEVWWQNMDEA

SEQ ID NO: 1086 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XEDWGIRWGWRYTLRWEAVLW

SEQ ID NO: 1087 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XFATLHEWRSGFMRHRHLRAS

SEQ ID NO: 1088 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XHGDSMWKWTVMRAPATGRGM

SEQ ID NO: 1089 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XGHGMNRWHRRLEAIMDIKRL

SEQ ID NO: 1090 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XRRYERATASSRRESQLVDSI

SEQ ID NO: 1091 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XGGHCTHTPWTYGVLAWVSRT

SEQ ID NO: 1092 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XFWSWGYQSLDGEWTSEWARI

SEQ ID NO: 1093 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XTRSGERGRKRVLSSYWLHSW

SEQ ID NO: 1094 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XWHWWMGTYQSSPWSTETEWW

SEQ ID NO: 1095 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XSSGHPRVRSKYSWGLIPLRR

SEQ ID NO: 1096 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XTGIYAWGWEIRSEWQNDSWF

SEQ ID NO: 1097 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XGWNVFYIFRVFEGKPKAWVM

SEQ ID NO: 1098 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XGGTLWQFEHGEHYLIMLGWE

SEQ ID NO: 1099 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XLEGNHWRDRYHHSVKASVPM

SEQ ID NO: 1100 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XIWGAQRWRDHRKGLVSMSMS

SEQ ID NO: 1101 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XRGVRRMPKSYPRQHTAIRVL

SEQ ID NO: 1102 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XLMAVHVPSTNNTKWVIDICK

SEQ ID NO: 1103 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XGIWIGQSKYIWRSQRGEQTI

SEQ ID NO: 1104 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XYEGIKPWTGSRVMMLMDMLT

SEQ ID NO: 1105 - protein, 18 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  DISULFID (5)..(15): Cys residues linked via disulfide bond
  MISC_FEATURE (18)..(18): C-terminal amidation
XKESCFWVSKWVAVCGHY

SEQ ID NO: 1106 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  DISULFID (9)..(19): Cys residues linked via disulfide bond
  MISC_FEATURE (21)..(21): C-terminal amidation
XVISQGHHCWHVNEKIAVCWL

SEQ ID NO: 1107 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  DISULFID (9)..(19): Cys residues linked via disulfide bond
  MISC_FEATURE (21)..(21): C-terminal amidation
XEREDTTYCVVVASGVELCWQ

SEQ ID NO: 1108 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  DISULFID (4)..(14): Cys residues linked via disulfide bond
  MISC_FEATURE (21)..(21): C-terminal amidation
XEHCRQIAPDVMLCWEWRAKS

SEQ ID NO: 1109 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  DISULFID (8)..(18): Cys residues linked via disulfide bond
  MISC_FEATURE (21)..(21): C-terminal amidation
XSAGSVSCFWVSSQVSVCWQL

SEQ ID NO: 1110 - protein, 7 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (7)..(7): C-terminal amidation
XQLELGF

SEQ ID NO: 1111 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XRGWTRYWIEVGWWHIDEELT

SEQ ID NO: 1112 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XFVHVGWVEYGWVLRSDYRHS

SEQ ID NO: 1113 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XHSEVSWLRSNDYYIEFGWEW

SEQ ID NO: 1114 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XRDIWDLWTYRIEFGWEWSDD

SEQ ID NO: 1115 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XYQHGEDGWYWIEFGWEFVDL

SEQ ID NO: 1116 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XAEKVDKESHVSYTVELWWEY

SEQ ID NO: 1117 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XRWQRLGKGETWEFWAYIPVV

SEQ ID NO: 1118 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XWTIGLWWENEHEEVMIWQVQ

SEQ ID NO: 1119 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XWIKIGWHHRDHEWDEDIGFM

SEQ ID NO: 1120 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XWELWSMDSLGKHTILGFGKW

SEQ ID NO: 1121 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XFRIELWYREGKSGNEKLVWS

SEQ ID NO: 1122 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XSLGHVHMGRRYTVELRWERA

SEQ ID NO: 1123 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XSVEFGFYDVENSMDWTVGWV

SEQ ID NO: 1124 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  DISULFID (4)..(14): Cys residues linked via disulfide bond
  MISC_FEATURE (21)..(21): C-terminal amidation
XDKCMQASQVVWVCVHQEWDP

SEQ ID NO: 1125 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XDLDPRIVLVGNGEIEIGWSI

SEQ ID NO: 1126 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  DISULFID (6)..(16): Cys residues linked via disulfide bond
  MISC_FEATURE (21)..(21): C-terminal amidation
XEAWNCIVVSKNISVCWSKSY

SEQ ID NO: 1127 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  DISULFID (6)..(16): Cys residues linked via disulfide bond
  MISC_FEATURE (21)..(21): C-terminal amidation
XEGEQCVVLRSGGSVCVGFER

SEQ ID NO: 1128 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XELPLALQGMESHGIVSWGWA

SEQ ID NO: 1129 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  DISULFID (4)..(15): Cys residues linked via disulfide bond
  MISC_FEATURE (21)..(21): C-terminal amidation
XEYCIWLIDDSIAVCWEESGN

SEQ ID NO: 1130 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  DISULFID (5)..(15): Cys residues linked via disulfide bond
  MISC_FEATURE (21)..(21): C-terminal amidation
XGEYCWEVNENVHVCYHVPDS

SEQ ID NO: 1131 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  DISULFID (5)..(14): Cys residues linked via disulfide bond
  MISC_FEATURE (21)..(21): C-terminal amidation
XIWMCWEDLKGSYCWEFVRQG

SEQ ID NO: 1132 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  DISULFID (8)..(18): Cys residues linked via disulfide bond
  MISC_FEATURE (21)..(21): C-terminal amidation
XLDGGHWCWEISDSVMLCVAV

SEQ ID NO: 1133 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  DISULFID (7)..(18): Cys residues linked via disulfide bond
  MISC_FEATURE (21)..(21): C-terminal amidation
XLSIWLCWEGEDHTFTVCRVL

SEQ ID NO: 1134 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  DISULFID (7)..(16): Cys residues linked via disulfide bond
  MISC_FEATURE (21)..(21): C-terminal amidation
XPGVELCWEANGWTTCISWPY

SEQ ID NO: 1135 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  DISULFID (10)..(19): Cys residues linked via disulfide bond
  MISC_FEATURE (21)..(21): C-terminal amidation
XRDEWQITVCWLGSIYEACWD

SEQ ID NO: 1136 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  DISULFID (9)..(19): Cys residues linked via disulfide bond
  MISC_FEATURE (21)..(21): C-terminal amidation
XRGQQGDHCTVITSFVTLCKE

SEQ ID NO: 1137 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  DISULFID (4)..(14): Cys residues linked via disulfide bond
  MISC_FEATURE (21)..(21): C-terminal amidation
XRSCIRINERLELCWEKTDLE

SEQ ID NO: 1138 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  DISULFID (8)..(17): Cys residues linked via disulfide bond
  MISC_FEATURE (21)..(21): C-terminal amidation
XSGGLYQCWGDDRIMLCWAYD

SEQ ID NO: 1139 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  DISULFID (8)..(17): Cys residues linked via disulfide bond
  MISC_FEATURE (21)..(21): C-terminal amidation
XSVGIWLCWMDSRGSVCHQLK

SEQ ID NO: 1140 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  DISULFID (9)..(19): Cys residues linked via disulfide bond
  MISC_FEATURE (21)..(21): C-terminal amidation
XTRAMGAICHRITEHVSVCYM

SEQ ID NO: 1141 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  DISULFID (9)..(19): Cys residues linked via disulfide bond
  MISC_FEATURE (21)..(21): C-terminal amidation
XTRTMGAICHRITEHVSVCYM

SEQ ID NO: 1142 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  DISULFID (5)..(18): Cys residues linked via disulfide bond
  MISC_FEATURE (21)..(21): C-terminal amidation
XVDHCTPLSRERAQVWVCWEV

SEQ ID NO: 1143 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  DISULFID (9)..(20): Cys residues linked via disulfide bond
  MISC_FEATURE (21)..(21): C-terminal amidation
XVRNTVWVCWYERSSTREWCH

SEQ ID NO: 1144 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  DISULFID (7)..(18): Cys residues linked via disulfide bond
  MISC_FEATURE (21)..(21): C-terminal amidation
XVSVWICWETLEGVPLECKLW

SEQ ID NO: 1145 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  DISULFID (5)..(15): Cys residues linked via disulfide bond
  MISC_FEATURE (21)..(21): C-terminal amidation
XVWICAVAARGPDICYYLVNA

SEQ ID NO: 1146 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  DISULFID (9)..(16): Cys residues linked via disulfide bond
  MISC_FEATURE (21)..(21): C-terminal amidation
XWQWEVLWCNDHNTVCVGLIQ

SEQ ID NO: 1147 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  DISULFID (8)..(18): Cys residues linked via disulfide bond
  MISC_FEATURE (21)..(21): C-terminal amidation
XWYGHDYCFKFSREIWICQMD

SEQ ID NO: 1148 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XAEIEWGWYVSDAEEFIVLGH

SEQ ID NO: 1149 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XAFWEAGWYDSVGNSWNVFFK

SEQ ID NO: 1150 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XAGVAVSEVTWGWYNMVDDTH

SEQ ID NO: 1151 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XAIELGYYSQSTDSSIILWQE

SEQ ID NO: 1152 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XAIEVGWYYLESTRHEVFTNA

SEQ ID NO: 1153 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XAWTWEFGTYNFMTDSYTLQW

SEQ ID NO: 1154 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XDSTIYVGWYSYDHDYDIWGY

SEQ ID NO: 1155 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XEHRHTRSKDPYYSVELMWEF

SEQ ID NO: 1156 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XEIEVGYETFESGEAVWWVAF

SEQ ID NO: 1157 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XELVLVWESTDGRVQLWAQWD

SEQ ID NO: 1158 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XEVRWELGIESRFSGWYMVLG

SEQ ID NO: 1159 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XEWQVTSTVWIGWELQMDLAT

SEQ ID NO: 1160 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XEYAVWELGYYSMWEDDHVII

SEQ ID NO: 1161 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XFDVPLWAWSSGEMYIEIGLH

SEQ ID NO: 1162 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XFGVVAVGYYDREYDKWTLIA

SEQ ID NO: 1163 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XFIVVGAYSKLTGLHIQWGYE

SEQ ID NO: 1164 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XFSGSGPWFVYLIGGSIEMGY

SEQ ID NO: 1165 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XFVSLWWETSNGRGEIARWII

SEQ ID NO: 1166 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XGAAWFITLDGGTVEIGWEQI

SEQ ID NO: 1167 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XGFYWEVGFYDYGSDSINVHA

SEQ ID NO: 1168 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XGHSVEIGWYNVAKDQPDMYY

SEQ ID NO: 1169 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XGKYLLLDFTFWLTKEVGVGW

SEQ ID NO: 1170 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XGLGWEVGWHVLESSHDLTIH

SEQ ID NO: 1171 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XGLIEWGWYSRQEDQHWLMGT

SEQ ID NO: 1172 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XGRWLIGLAPQAEVWFLWQPM

SEQ ID NO: 1173 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XGTEIGWLDLLTDHVIWSVTI

SEQ ID NO: 1174 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XGTQERGSKRMMFTVELWWEP

SEQ ID NO: 1175 - protein, 20 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (20)..(20): C-terminal amidation
XGWFMEVATVLGVIEVGWVV

SEQ ID NO: 1176 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XGWIFIGLHSYHTGMESEWPG

SEQ ID NO: 1177 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XHLHYNGGTIYWGSEPFNASW

SEQ ID NO: 1178 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XHMRGTATSERRYWIEVGWFD

SEQ ID NO: 1179 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XHMTVEFGYYWVEMDTNTVIW

SEQ ID NO: 1180 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XIEVGWYNVVTQKHSKLGMLI

SEQ ID NO: 1181 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XISVGWYFWATDNYKEFGNTL

SEQ ID NO: 1182 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XKFKRWEIGFMLESGEEYVLA

SEQ ID NO: 1183 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XKVWSRVQIIRGGWIEVGYEF

SEQ ID NO: 1184 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XLGVEMGYHVYQTGEDYIVLT

SEQ ID NO: 1185 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XLGVEMGYHVYQTGGDYIVLT

SEQ ID NO: 1186 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XLIEAGYHDIASQSDRILVRY

SEQ ID NO: 1187 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XLIVFGYSYIETEEEFIISLH

SEQ ID NO: 1188 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XLLWHTGDHSVSLFYEVLDYP

SEQ ID NO: 1189 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XLWMVRILRTDGAEVVVGWEL

SEQ ID NO: 1190 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XMGLWYGWEYVNGLGGHEIEI

SEQ ID NO: 1191 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XNHVWEVQLDKSVWIGWEWID

SEQ ID NO: 1192 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XNSSNSNGQKFRYFIEVGWYH

SEQ ID NO: 1193 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XNTTGRIELWIQLPDRDWLLW

SEQ ID NO: 1194 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XPYFVELGYEGYGVFYKIELL

SEQ ID NO: 1195 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XPYGVWYSWDNTSWLQISTHV

SEQ ID NO: 1196 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XQFFGLISGDGRLQIWIGWYE

SEQ ID NO: 1197 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XQGKYGIVAWGWVPSGGHRYQ

SEQ ID NO: 1198 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XQIQWGYEYASGWQNWWERSN

SEQ ID NO: 1199 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XQVELWFEDRSTGQQYRLATI

SEQ ID NO: 1200 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XQVSSIELWAEYGDVPRLIWS

SEQ ID NO: 1201 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XQWDWVEYEWGNTGLVGWGYE

SEQ ID NO: 1202 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XQWRILIGLHEMGTGYDLVLW

SEQ ID NO: 1203 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XQWWSVGYYDFEQDVHVVWKT

SEQ ID NO: 1204 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XRLIELGFWYEIAEEHVVVWS

SEQ ID NO: 1205 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XRRITLGWYVYSNNTYMIWTT

SEQ ID NO: 1206 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XRWIVYSHEVEISKGVWLGYE

SEQ ID NO: 1207 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XRYGYIVVGWYDFNKDLYTRF

SEQ ID NO: 1208 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XSGIILGWYSVYRNEWFEWGT

SEQ ID NO: 1209 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XSGRGTPAGDHKYSIEAFYYT

SEQ ID NO: 1210 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XSIRQRDQYTIELYWEWVDSP

SEQ ID NO: 1211 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XSLIWSSNTSGRYRVELWAER

SEQ ID NO: 1212 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XSLSRSDEAKLLWRIEFGWEY

SEQ ID NO: 1213 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XSNKYRLVSDLQYTVEFGWEW

SEQ ID NO: 1214 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XSQKPDETRMSRYSIELFWEL

SEQ ID NO: 1215 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XSTIWLWTNGIVEVGWEFTDY

SEQ ID NO: 1216 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XSVSVGWYYTVEERHYMLWLG

SEQ ID NO: 1217 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XSVTVGWYSWIEDMEWTVYSQ

SEQ ID NO: 1218 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XSWRVEIGWHWLISGIDEPTI

SEQ ID NO: 1219 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XTIVIGHLDRVSGVETDFYSV

SEQ ID NO: 1220 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XTRRTGFSVQFGWEVSSQYTH

SEQ ID NO: 1221 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XTVELWIWNTFTDHSHMIASI

SEQ ID NO: 1222 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XTYVYWEVGLESANGAKEIWQ

SEQ ID NO: 1223 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XVEFGWYRRESDTWHSWGKVN

SEQ ID NO: 1224 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XVEIGWHFLKYEKELVWYMHQ

SEQ ID NO: 1225 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XVEIGWHFLNYEKELVWYMHQ

SEQ ID NO: 1226 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XVEVGWEQDGVTVWTVTWYHT

SEQ ID NO: 1227 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XVEVGWVSLFKDLTVFKEWIP

SEQ ID NO: 1228 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XVFEVGWVTSDGRVLWRTIRN

SEQ ID NO: 1229 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XVIWRDGRSLERWSIEFGWEA

SEQ ID NO: 1230 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XVRPKEIRKRPLFYVELFWEH

SEQ ID NO: 1231 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XVVEIGWVLVSSLGNEKVVLW

SEQ ID NO: 1232 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XVYSVESGWYSFNDDEWMSFY

SEQ ID NO: 1233 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XWEIELGLVMNGQEYMIVTLY

SEQ ID NO: 1234 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XWEYWEVYTIGPVTVGWELIA

SEQ ID NO: 1235 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XWGIMELGMYWYEDGRHKAIW

SEQ ID NO: 1236 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XWGITLGWEDGHGNEHDEYVL

SEQ ID NO: 1237 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XWGVVEVGYHFVATGSNEALW

SEQ ID NO: 1238 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XWGWIVSAGWHYSAMAEDHPW

SEQ ID NO: 1239 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XWIFTWSSGDHIGVIEMGYES

SEQ ID NO: 1240 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XWIVIGWEDAYGRSVIWYKVG

SEQ ID NO: 1241 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XWKIIVGWELFDTGETTWWKV

SEQ ID NO: 1242 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XWKWRTFDGSIEIGFVAVQWS

SEQ ID NO: 1243 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XWLIEFGYMWNGENRTLAVWE

SEQ ID NO: 1244 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XWRETIFYVTDQISVVILEKV

SEQ ID NO: 1245 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XWSPGMKEIELGSTGIYWGWS

SEQ ID NO: 1246 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XWVEFGYYDPETDESTILTEW

SEQ ID NO: 1247 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XYSIVYGHYQKQTNTWTELVY

SEQ ID NO: 1248 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XYTVEVGWHTVHTGRDNYMWM

SEQ ID NO: 1249 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XYVEVGYYFHTTDNEVIIYAN

SEQ ID NO: 1250 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XYVEVGYYFYTTDNEVIIYAN

SEQ ID NO: 1251 - protein, 20 aa, Artificial Sequence
  Synthetic peptide
  MISC_FEATURE (1)..(1): N-terminal acetylation
  MISC_FEATURE (20)..(20): C-terminal amidation
AFWEAGWYDSVGNSWNVFFK

SEQ ID NO: 1252 - protein, 20 aa, Artificial Sequence
  Synthetic peptide
  MISC_FEATURE (1)..(1): N-terminal acetylation
  MISC_FEATURE (20)..(20): C-terminal amidation
HLYLWQRWPSPWVEVGWEFV

SEQ ID NO: 1253 - protein, 20 aa, Artificial Sequence
  Synthetic peptide
  MISC_FEATURE (1)..(1): N-terminal acetylation
  MISC_FEATURE (20)..(20): C-terminal amidation
RPTTLIRLGANSWIEIGWEI

SEQ ID NO: 1254 - protein, 20 aa, Artificial Sequence
  Synthetic peptide
  MISC_FEATURE (1)..(1): N-terminal acetylation
  MISC_FEATURE (20)..(20): C-terminal amidation
YILWSVYVGPGIEVGWTESA

SEQ ID NO: 1255 - protein, 20 aa, Artificial Sequence
  Synthetic peptide
  MISC_FEATURE (1)..(1): N-terminal acetylation
  MISC_FEATURE (20)..(20): C-terminal amidation
DLDPRIVLVGNGEIEIGWSI

SEQ ID NO: 1256 - protein, 20 aa, Artificial Sequence
  Synthetic peptide
  MISC_FEATURE (1)..(1): N-terminal acetylation
  MISC_FEATURE (20)..(20): C-terminal amidation
WKIIVGWELFDTGETTWWKV

SEQ ID NO: 1257 - protein, 20 aa, Artificial Sequence
  Synthetic peptide
  MISC_FEATURE (1)..(1): N-terminal acetylation
  MISC_FEATURE (20)..(20): C-terminal amidation
ALYLWQRWPSPWVEVGWEFV

SEQ ID NO: 1258 - protein, 20 aa, Artificial Sequence
  Synthetic peptide
  MISC_FEATURE (1)..(1): N-terminal acetylation
  MISC_FEATURE (20)..(20): C-terminal amidation
HAYLWQRWPSPWVEVGWEFV

SEQ ID NO: 1259 - protein, 20 aa, Artificial Sequence
  Synthetic peptide
  MISC_FEATURE (1)..(1): N-terminal acetylation
  MISC_FEATURE (20)..(20): C-terminal amidation
HLALWQRWPSPWVEVGWEFV

SEQ ID NO: 1260 - protein, 20 aa, Artificial Sequence
  Synthetic peptide
  MISC_FEATURE (1)..(1): N-terminal acetylation
  MISC_FEATURE (20)..(20): C-terminal amidation
HLYAWQRWPSPWVEVGWEFV

SEQ ID NO: 1261 - protein, 20 aa, Artificial Sequence
  Synthetic peptide
  MISC_FEATURE (1)..(1): N-terminal acetylation
  MISC_FEATURE (20)..(20): C-terminal amidation
HLYLAQRWPSPWVEVGWEFV

SEQ ID NO: 1262 - protein, 20 aa, Artificial Sequence
  Synthetic peptide
  MISC_FEATURE (1)..(1): N-terminal acetylation
  MISC_FEATURE (20)..(20): C-terminal amidation
HLYLWARWPSPWVEVGWEFV

SEQ ID NO: 1263 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWPSPWVEVGWEFV

SEQ ID NO: 1264 - protein, 20 aa, Artificial Sequence
  Synthetic peptide
  MISC_FEATURE (1)..(1): N-terminal acetylation
  MISC_FEATURE (20)..(20): C-terminal amidation
HLYLWQRAPSPWVEVGWEFV

SEQ ID NO: 1265 - protein, 20 aa, Artificial Sequence
  Synthetic peptide
  MISC_FEATURE (1)..(1): N-terminal acetylation
  MISC_FEATURE (20)..(20): C-terminal amidation
HLYLWQRWASPWVEVGWEFV

SEQ ID NO: 1266 - protein, 20 aa, Artificial Sequence
  Synthetic peptide
  MISC_FEATURE (1)..(1): N-terminal acetylation
  MISC_FEATURE (20)..(20): C-terminal amidation
HLYLWQRWPAPWVEVGWEFV

SEQ ID NO: 1267 - protein, 20 aa, Artificial Sequence
  Synthetic peptide
  MISC_FEATURE (1)..(1): N-terminal acetylation
  MISC_FEATURE (20)..(20): C-terminal amidation
HLYLWQRWPSAWVEVGWEFV

SEQ ID NO: 1268 - protein, 20 aa, Artificial Sequence
  Synthetic peptide
  MISC_FEATURE (1)..(1): N-terminal acetylation
  MISC_FEATURE (20)..(20): C-terminal amidation
HLYLWQRWPSPAVEVGWEFV

SEQ ID NO: 1269 - protein, 20 aa, Artificial Sequence
  Synthetic peptide
  MISC_FEATURE (1)..(1): N-terminal acetylation
  MISC_FEATURE (20)..(20): C-terminal amidation
HLYLWQRWPSPWAEVGWEFV

SEQ ID NO: 1270 - protein, 20 aa, Artificial Sequence
  Synthetic peptide
  MISC_FEATURE (1)..(1): N-terminal acetylation
  MISC_FEATURE (20)..(20): C-terminal amidation
HLYLWQRWPSPWVAVGWEFV

SEQ ID NO: 1271 - protein, 20 aa, Artificial Sequence
  Synthetic peptide
  MISC_FEATURE (1)..(1): N-terminal acetylation
  MISC_FEATURE (20)..(20): C-terminal amidation
HLYLWQRWPSPWVEAGWEFV

SEQ ID NO: 1272 - protein, 20 aa, Artificial Sequence
  Synthetic peptide
  MISC_FEATURE (1)..(1): N-terminal acetylation
  MISC_FEATURE (20)..(20): C-terminal amidation
HLYLWQRWPSPWVEVAWEFV

SEQ ID NO: 1273 - protein, 20 aa, Artificial Sequence
  Synthetic peptide
  MISC_FEATURE (1)..(1): N-terminal acetylation
  MISC_FEATURE (20)..(20): C-terminal amidation
HLYLWQRWPSPWVEVGAEFV

SEQ ID NO: 1274 - protein, 20 aa, Artificial Sequence
  Synthetic peptide
  MISC_FEATURE (1)..(1): N-terminal acetylation
  MISC_FEATURE (20)..(20): C-terminal amidation
HLYLWQRWPSPWVEVGWAFV

SEQ ID NO: 1275 - protein, 20 aa, Artificial Sequence
  Synthetic peptide
  MISC_FEATURE (1)..(1): N-terminal acetylation
  MISC_FEATURE (20)..(20): C-terminal amidation
HLYLWQRWPSPWVEVGWEAV

SEQ ID NO: 1276 - protein, 20 aa, Artificial Sequence
  Synthetic peptide
  MISC_FEATURE (1)..(1): N-terminal acetylation
  MISC_FEATURE (20)..(20): C-terminal amidation
HLYLWQRWPSPWVEVGWEFA

SEQ ID NO: 1277 - protein, 20 aa, Artificial Sequence
  Synthetic peptide
  MISC_FEATURE (1)..(1): N-terminal acetylation
  MISC_FEATURE (20)..(20): C-terminal amidation
DLYLWQRWPSPWVEVGWEFV

SEQ ID NO: 1278 - protein, 20 aa, Artificial Sequence
  Synthetic peptide
  MISC_FEATURE (1)..(1): N-terminal acetylation
  MISC_FEATURE (20)..(20): C-terminal amidation
HDYLWQRWPSPWVEVGWEFV

SEQ ID NO: 1279 - protein, 20 aa, Artificial Sequence
  Synthetic peptide
  MISC_FEATURE (1)..(1): N-terminal acetylation
  MISC_FEATURE (20)..(20): C-terminal amidation
HLDLWQRWPSPWVEVGWEFV

SEQ ID NO: 1280 - protein, 20 aa, Artificial Sequence
  Synthetic peptide
  MISC_FEATURE (1)..(1): N-terminal acetylation
  MISC_FEATURE (20)..(20): C-terminal amidation
HLYDWQRWPSPWVEVGWEFV

SEQ ID NO: 1281 - protein, 20 aa, Artificial Sequence
  Synthetic peptide
  MISC_FEATURE (1)..(1): N-terminal acetylation
  MISC_FEATURE (20)..(20): C-terminal amidation
HLYLDQRWPSPWVEVGWEFV

SEQ ID NO: 1282 - protein, 20 aa, Artificial Sequence
  Synthetic peptide
  MISC_FEATURE (1)..(1): N-terminal acetylation
  MISC_FEATURE (20)..(20): C-terminal amidation
HLYLWDRWPSPWVEVGWEFV

SEQ ID NO: 1283 - protein, 20 aa, Artificial Sequence
  Synthetic peptide
  MISC_FEATURE (1)..(1): N-terminal acetylation
  MISC_FEATURE (20)..(20): C-terminal amidation
HLYLWQDWPSPWVEVGWEFV

SEQ ID NO: 1284 - protein, 20 aa, Artificial Sequence
  Synthetic peptide
  MISC_FEATURE (1)..(1): N-terminal acetylation
  MISC_FEATURE (20)..(20): C-terminal amidation
HLYLWQRDPSPWVEVGWEFV

SEQ ID NO: 1285 - protein, 20 aa, Artificial Sequence
  Synthetic peptide
  MISC_FEATURE (1)..(1): N-terminal acetylation
  MISC_FEATURE (20)..(20): C-terminal amidation
HLYLWQRWDSPWVEVGWEFV

SEQ ID NO: 1286 - protein, 20 aa, Artificial Sequence
  Synthetic peptide
  MISC_FEATURE (1)..(1): N-terminal acetylation
  MISC_FEATURE (20)..(20): C-terminal amidation
HLYLWQRWPDPWVEVGWEFV

SEQ ID NO: 1287 - protein, 20 aa, Artificial Sequence
  Synthetic peptide
  MISC_FEATURE (1)..(1): N-terminal acetylation
  MISC_FEATURE (20)..(20): C-terminal amidation
HLYLWQRWPSDWVEVGWEFV

SEQ ID NO: 1288 - protein, 20 aa, Artificial Sequence
  Synthetic peptide
  MISC_FEATURE (1)..(1): N-terminal acetylation
  MISC_FEATURE (20)..(20): C-terminal amidation
HLYLWQRWPSPDVEVGWEFV

SEQ ID NO: 1289 - protein, 20 aa, Artificial Sequence
  Synthetic peptide
  MISC_FEATURE (1)..(1): N-terminal acetylation
  MISC_FEATURE (20)..(20): C-terminal amidation
HLYLWQRWPSPWDEVGWEFV

SEQ ID NO: 1290 - protein, 20 aa, Artificial Sequence
  Synthetic peptide
  MISC_FEATURE (1)..(1): N-terminal acetylation
  MISC_FEATURE (20)..(20): C-terminal amidation
HLYLWQRWPSPWVDVGWEFV

SEQ ID NO: 1291 - protein, 20 aa, Artificial Sequence
  Synthetic peptide
  MISC_FEATURE (1)..(1): N-terminal acetylation
  MISC_FEATURE (20)..(20): C-terminal amidation
HLYLWQRWPSPWVEDGWEFV

SEQ ID NO: 1292 - protein, 20 aa, Artificial Sequence
  Synthetic peptide
  MISC_FEATURE (1)..(1): N-terminal acetylation
  MISC_FEATURE (20)..(20): C-terminal amidation
HLYLWQRWPSPWVEVDWEFV

SEQ ID NO: 1293 - protein, 20 aa, Artificial Sequence
  Synthetic peptide
  MISC_FEATURE (1)..(1): N-terminal acetylation
  MISC_FEATURE (20)..(20): C-terminal amidation
HLYLWQRWPSPWVEVGDEFV

SEQ ID NO: 1294 - protein, 20 aa, Artificial Sequence
  Synthetic peptide
  MISC_FEATURE (1)..(1): N-terminal acetylation
  MISC_FEATURE (20)..(20): C-terminal amidation
HLYLWQRWPSPWVEVGWDFV

SEQ ID NO: 1295 - protein, 20 aa, Artificial Sequence
  Synthetic peptide
  MISC_FEATURE (1)..(1): N-terminal acetylation
  MISC_FEATURE (20)..(20): C-terminal amidation
HLYLWQRWPSPWVEVGWEDV

SEQ ID NO: 1296 - protein, 20 aa, Artificial Sequence
  Synthetic peptide
  MISC_FEATURE (1)..(1): N-terminal acetylation
  MISC_FEATURE (20)..(20): C-terminal amidation
HLYLWQRWPSPWVEVGWEFD

SEQ ID NO: 1297 - protein, 20 aa, Artificial Sequence
  Synthetic peptide
  MISC_FEATURE (1)..(1): N-terminal acetylation
  MISC_FEATURE (20)..(20): C-terminal amidation
FLYLWQRWPSPWVEVGWEFV

SEQ ID NO: 1298 - protein, 20 aa, Artificial Sequence
  Synthetic peptide
  MISC_FEATURE (1)..(1): N-terminal acetylation
  MISC_FEATURE (20)..(20): C-terminal amidation
HFYLWQRWPSPWVEVGWEFV

SEQ ID NO: 1299 - protein, 20 aa, Artificial Sequence
  Synthetic peptide
  MISC_FEATURE (1)..(1): N-terminal acetylation
  MISC_FEATURE (20)..(20): C-terminal amidation
HLFLWQRWPSPWVEVGWEFV

SEQ ID NO: 1300 - protein, 20 aa, Artificial Sequence
  Synthetic peptide
  MISC_FEATURE (1)..(1): N-terminal acetylation
  MISC_FEATURE (20)..(20): C-terminal amidation
HLYFWQRWPSPWVEVGWEFV

SEQ ID NO: 1301 - protein, 20 aa, Artificial Sequence
  Synthetic peptide
  MISC_FEATURE (1)..(1): N-terminal acetylation
  MISC_FEATURE (20)..(20): C-terminal amidation
HLYLFQRWPSPWVEVGWEFV

SEQ ID NO: 1302 - protein, 20 aa, Artificial Sequence
  Synthetic peptide
  MISC_FEATURE (1)..(1): N-terminal acetylation
  MISC_FEATURE (20)..(20): C-terminal amidation
HLYLWFRWPSPWVEVGWEFV

SEQ ID NO: 1303 - protein, 20 aa, Artificial Sequence
  Synthetic peptide
  MISC_FEATURE (1)..(1): N-terminal acetylation
  MISC_FEATURE (20)..(20): C-terminal amidation
HLYLWQFWPSPWVEVGWEFV

SEQ ID NO: 1304 - protein, 20 aa, Artificial Sequence
  Synthetic peptide
  MISC_FEATURE (1)..(1): N-terminal acetylation
  MISC_FEATURE (20)..(20): C-terminal amidation
HLYLWQRFPSPWVEVGWEFV

SEQ ID NO: 1305 - protein, 20 aa, Artificial Sequence
  Synthetic peptide
  MISC_FEATURE (1)..(1): N-terminal acetylation
  MISC_FEATURE (20)..(20): C-terminal amidation
HLYLWQRWFSPWVEVGWEFV

SEQ ID NO: 1306 - protein, 20 aa, Artificial Sequence
  Synthetic peptide
  MISC_FEATURE (1)..(1): N-terminal acetylation
  MISC_FEATURE (20)..(20): C-terminal amidation
HLYLWQRWPFPWVEVGWEFV

SEQ ID NO: 1307 - protein, 20 aa, Artificial Sequence
  Synthetic peptide
  MISC_FEATURE (1)..(1): N-terminal acetylation
  MISC_FEATURE (20)..(20): C-terminal amidation
HLYLWQRWPSFWVEVGWEFV

SEQ ID NO: 1308 - protein, 20 aa, Artificial Sequence
  Synthetic peptide
  MISC_FEATURE (1)..(1): N-terminal acetylation
  MISC_FEATURE (20)..(20): C-terminal amidation
HLYLWQRWPSPFVEVGWEFV

SEQ ID NO: 1309 - protein, 20 aa, Artificial Sequence
  Synthetic peptide
  MISC_FEATURE (1)..(1): N-terminal acetylation
  MISC_FEATURE (20)..(20): C-terminal amidation
HLYLWQRWPSPWFEVGWEFV

SEQ ID NO: 1310 - protein, 20 aa, Artificial Sequence
  Synthetic peptide
  MISC_FEATURE (1)..(1): N-terminal acetylation
  MISC_FEATURE (20)..(20): C-terminal amidation
HLYLWQRWPSPWVFVGWEFV

SEQ ID NO: 1311 - protein, 20 aa, Artificial Sequence
  Synthetic peptide
  MISC_FEATURE (1)..(1): N-terminal acetylation
  MISC_FEATURE (20)..(20): C-terminal amidation
HLYLWQRWPSPWVEFGWEFV

SEQ ID NO: 1312 - protein, 20 aa, Artificial Sequence
  Synthetic peptide
  MISC_FEATURE (1)..(1): N-terminal acetylation
  MISC_FEATURE (20)..(20): C-terminal amidation
HLYLWQRWPSPWVEVFWEFV

SEQ ID NO: 1313 - protein, 20 aa, Artificial Sequence
  Synthetic peptide
  MISC_FEATURE (1)..(1): N-terminal acetylation
  MISC_FEATURE (20)..(20): C-terminal amidation
HLYLWQRWPSPWVEVGFEFV

SEQ ID NO: 1314 - protein, 20 aa, Artificial Sequence
  Synthetic peptide
  MISC_FEATURE (1)..(1): N-terminal acetylation
  MISC_FEATURE (20)..(20): C-terminal amidation
HLYLWQRWPSPWVEVGWFFV

SEQ ID NO: 1315 - protein, 20 aa, Artificial Sequence
  Synthetic peptide
  MISC_FEATURE (1)..(1): N-terminal acetylation
  MISC_FEATURE (20)..(20): C-terminal amidation
HLYLWQRWPSPWVEVGWEFF

SEQ ID NO: 1316 - protein, 20 aa, Artificial Sequence
  Synthetic peptide
  MISC_FEATURE (1)..(1): N-terminal acetylation
  MISC_FEATURE (20)..(20): C-terminal amidation
GLYLWQRWPSPWVEVGWEFV

SEQ ID NO: 1317 - protein, 20 aa, Artificial Sequence
  Synthetic peptide
  MISC_FEATURE (1)..(1): N-terminal acetylation
  MISC_FEATURE (20)..(20): C-terminal amidation
HGYLWQRWPSPWVEVGWEFV

SEQ ID NO: 1318 - protein, 20 aa, Artificial Sequence
  Synthetic peptide
  MISC_FEATURE (1)..(1): N-terminal acetylation
  MISC_FEATURE (20)..(20): C-terminal amidation
HLGLWQRWPSPWVEVGWEFV

SEQ ID NO: 1319 - protein, 20 aa, Artificial Sequence
  Synthetic peptide
  MISC_FEATURE (1)..(1): N-terminal acetylation
  MISC_FEATURE (20)..(20): C-terminal amidation
HLYGWQRWPSPWVEVGWEFV

SEQ ID NO: 1320 - protein, 20 aa, Artificial Sequence
  Synthetic peptide
  MISC_FEATURE (1)..(1): N-terminal acetylation
  MISC_FEATURE (20)..(20): C-terminal amidation
HLYLGQRWPSPWVEVGWEFV

SEQ ID NO: 1321 - protein, 20 aa, Artificial Sequence
  Synthetic peptide
  MISC_FEATURE (1)..(1): N-terminal acetylation
  MISC_FEATURE (20)..(20): C-terminal amidation
HLYLWGRWPSPWVEVGWEFV

SEQ ID NO: 1322 - protein, 20 aa, Artificial Sequence
  Synthetic peptide
  MISC_FEATURE (1)..(1): N-terminal acetylation
  MISC_FEATURE (20)..(20): C-terminal amidation
HLYLWQGWPSPWVEVGWEFV

SEQ ID NO: 1323 - protein, 20 aa, Artificial Sequence
  Synthetic peptide
  MISC_FEATURE (1)..(1): N-terminal acetylation
  MISC_FEATURE (20)..(20): C-terminal amidation
HLYLWQRGPSPWVEVGWEFV

SEQ ID NO: 1324 - protein, 20 aa, Artificial Sequence
  Synthetic peptide
  MISC_FEATURE (1)..(1): N-terminal acetylation
  MISC_FEATURE (20)..(20): C-terminal amidation
HLYLWQRWGSPWVEVGWEFV

SEQ ID NO: 1325 - protein, 20 aa, Artificial Sequence
  Synthetic peptide
  MISC_FEATURE (1)..(1): N-terminal acetylation
  MISC_FEATURE (20)..(20): C-terminal amidation
HLYLWQRWPGPWVEVGWEFV

SEQ ID NO: 1326 - protein, 20 aa, Artificial Sequence
  Synthetic peptide
  MISC_FEATURE (1)..(1): N-terminal acetylation
  MISC_FEATURE (20)..(20): C-terminal amidation
HLYLWQRWPSGWVEVGWEFV

SEQ ID NO: 1327 - protein, 20 aa, Artificial Sequence
  Synthetic peptide
  MISC_FEATURE (1)..(1): N-terminal acetylation
  MISC_FEATURE (20)..(20): C-terminal amidation
HLYLWQRWPSPGVEVGWEFV

SEQ ID NO: 1328 - protein, 20 aa, Artificial Sequence
  Synthetic peptide
  MISC_FEATURE (1)..(1): N-terminal acetylation
  MISC_FEATURE (20)..(20): C-terminal amidation
HLYLWQRWPSPWGEVGWEFV

SEQ ID NO: 1329 - protein, 20 aa, Artificial Sequence
  Synthetic peptide
  MISC_FEATURE (1)..(1): N-terminal acetylation
  MISC_FEATURE (20)..(20): C-terminal amidation
HLYLWQRWPSPWVGVGWEFV

SEQ ID NO: 1330 - protein, 20 aa, Artificial Sequence
  Synthetic peptide
  MISC_FEATURE (1)..(1): N-terminal acetylation
  MISC_FEATURE (20)..(20): C-terminal amidation
HLYLWQRWPSPWVEGGWEFV

SEQ ID NO: 1331 - protein, 20 aa, Artificial Sequence
  Synthetic peptide
  MISC_FEATURE (1)..(1): N-terminal acetylation
  MISC_FEATURE (20)..(20): C-terminal amidation
HLYLWQRWPSPWVEVGGEFV

SEQ ID NO: 1332 - protein, 20 aa, Artificial Sequence
  Synthetic peptide
  MISC_FEATURE (1)..(1): N-terminal acetylation
  MISC_FEATURE (20)..(20): C-terminal amidation
HLYLWQRWPSPWVEVGWGFV

SEQ ID NO: 1333 - protein, 20 aa, Artificial Sequence
  Synthetic peptide
  MISC_FEATURE (1)..(1): N-terminal acetylation
  MISC_FEATURE (20)..(20): C-terminal amidation
HLYLWQRWPSPWVEVGWEGV

SEQ ID NO: 1334 - protein, 20 aa, Artificial Sequence
  Synthetic peptide
  MISC_FEATURE (1)..(1): N-terminal acetylation
  MISC_FEATURE (20)..(20): C-terminal amidation
HLYLWQRWPSPWVEVGWEFG

SEQ ID NO: 1335 - protein, 20 aa, Artificial Sequence
  Synthetic peptide
  MISC_FEATURE (1)..(1): N-terminal acetylation
  MISC_FEATURE (20)..(20): C-terminal amidation
KLYLWQRWPSPWVEVGWEFV

SEQ ID NO: 1336 - protein, 20 aa, Artificial Sequence
  Synthetic peptide
  MISC_FEATURE (1)..(1): N-terminal acetylation
  MISC_FEATURE (20)..(20): C-terminal amidation
HKYLWQRWPSPWVEVGWEFV

SEQ ID NO: 1337 - protein, 20 aa, Artificial Sequence
  Synthetic peptide
  MISC_FEATURE (1)..(1): N-terminal acetylation
  MISC_FEATURE (20)..(20): C-terminal amidation
HLKLWQRWPSPWVEVGWEFV

SEQ ID NO: 1338 - protein, 20 aa, Artificial Sequence
  Synthetic peptide
  MISC_FEATURE (1)..(1): N-terminal acetylation
  MISC_FEATURE (20)..(20): C-terminal amidation
HLYKWQRWPSPWVEVGWEFV

SEQ ID NO: 1339 - protein, 20 aa, Artificial Sequence
  Synthetic peptide
  MISC_FEATURE (1)..(1): N-terminal acetylation
  MISC_FEATURE (20)..(20): C-terminal amidation
HLYLKQRWPSPWVEVGWEFV

SEQ ID NO: 1340 - protein, 20 aa, Artificial Sequence
  Synthetic peptide
  MISC_FEATURE (1)..(1): N-terminal acetylation
  MISC_FEATURE (20)..(20): C-terminal amidation
HLYLWKRWPSPWVEVGWEFV

SEQ ID NO: 1341 - protein, 20 aa, Artificial Sequence
  Synthetic peptide
  MISC_FEATURE (1)..(1): N-terminal acetylation
  MISC_FEATURE (20)..(20): C-terminal amidation
HLYLWQKWPSPWVEVGWEFV

SEQ ID NO: 1342 - protein, 20 aa, Artificial Sequence
  Synthetic peptide
  MISC_FEATURE (1)..(1): N-terminal acetylation
  MISC_FEATURE (20)..(20): C-terminal amidation
HLYLWQRKPSPWVEVGWEFV

SEQ ID NO: 1343 - protein, 20 aa, Artificial Sequence
  Synthetic peptide
  MISC_FEATURE (1)..(1): N-terminal acetylation
  MISC_FEATURE (20)..(20): C-terminal amidation
HLYLWQRWKSPWVEVGWEFV

SEQ ID NO: 1344 - protein, 20 aa, Artificial Sequence
  Synthetic peptide
  MISC_FEATURE (1)..(1): N-terminal acetylation
  MISC_FEATURE (20)..(20): C-terminal amidation
HLYLWQRWPKPWVEVGWEFV

SEQ ID NO: 1345 - protein, 20 aa, Artificial Sequence
  Synthetic peptide
  MISC_FEATURE (1)..(1): N-terminal acetylation
  MISC_FEATURE (20)..(20): C-terminal amidation
HLYLWQRWPSKWVEVGWEFV

SEQ ID NO: 1346 - protein, 20 aa, Artificial Sequence
  Synthetic peptide
  MISC_FEATURE (1)..(1): N-terminal acetylation
  MISC_FEATURE (20)..(20): C-terminal amidation
HLYLWQRWPSPKVEVGWEFV

SEQ ID NO: 1347 - protein, 20 aa, Artificial Sequence
  Synthetic peptide
  MISC_FEATURE (1)..(1): N-terminal acetylation
  MISC_FEATURE (20)..(20): C-terminal amidation
HLYLWQRWPSPWKEVGWEFV

SEQ ID NO: 1348 - protein, 20 aa, Artificial Sequence
  Synthetic peptide
  MISC_FEATURE (1)..(1): N-terminal acetylation
  MISC_FEATURE (20)..(20): C-terminal amidation
HLYLWQRWPSPWVKVGWEFV

SEQ ID NO: 1349 - protein, 20 aa, Artificial Sequence
  Synthetic peptide
  MISC_FEATURE (1)..(1): N-terminal acetylation
  MISC_FEATURE (20)..(20): C-terminal amidation
HLYLWQRWPSPWVEKGWEFV

SEQ ID NO: 1350 - protein, 20 aa, Artificial Sequence
  Synthetic peptide
  MISC_FEATURE (1)..(1): N-terminal acetylation
  MISC_FEATURE (20)..(20): C-terminal amidation
HLYLWQRWPSPWVEVKWEFV

SEQ ID NO: 1351 - protein, 20 aa, Artificial Sequence
  Synthetic peptide
  MISC_FEATURE (1)..(1): N-terminal acetylation
  MISC_FEATURE (20)..(20): C-terminal amidation
HLYLWQRWPSPWVEVGKEFV

SEQ ID NO: 1352 - protein, 20 aa, Artificial Sequence
  Synthetic peptide
  MISC_FEATURE (1)..(1): N-terminal acetylation
  MISC_FEATURE (20)..(20): C-terminal amidation
HLYLWQRWPSPWVEVGWKFV

SEQ ID NO: 1353 - protein, 20 aa, Artificial Sequence
  Synthetic peptide
  MISC_FEATURE (1)..(1): N-terminal acetylation
  MISC_FEATURE (20)..(20): C-terminal amidation
HLYLWQRWPSPWVEVGWEKV

SEQ ID NO: 1354 - protein, 20 aa, Artificial Sequence
  Synthetic peptide
  MISC_FEATURE (1)..(1): N-terminal acetylation
  MISC_FEATURE (20)..(20): C-terminal amidation
HLYLWQRWPSPWVEVGWEFK

SEQ ID NO: 1355 - protein, 20 aa, Artificial Sequence
  Synthetic peptide
  MISC_FEATURE (1)..(1): N-terminal acetylation
  MISC_FEATURE (20)..(20): C-terminal amidation
LLYLWQRWPSPWVEVGWEFV

SEQ ID NO: 1356 - protein, 20 aa, Artificial Sequence
  Synthetic peptide
  MISC_FEATURE (1)..(1): N-terminal acetylation
  MISC_FEATURE (20)..(20): C-terminal amidation
HLLLWQRWPSPWVEVGWEFV

SEQ ID NO: 1357 - protein, 20 aa, Artificial Sequence
  Synthetic peptide
  MISC_FEATURE (1)..(1): N-terminal acetylation
  MISC_FEATURE (20)..(20): C-terminal amidation
HLYLLQRWPSPWVEVGWEFV

SEQ ID NO: 1358 - protein, 20 aa, Artificial Sequence
  Synthetic peptide
  MISC_FEATURE (1)..(1): N-terminal acetylation
  MISC_FEATURE (20)..(20): C-terminal amidation
HLYLWLRWPSPWVEVGWEFV

SEQ ID NO: 1359 - protein, 20 aa, Artificial Sequence
  Synthetic peptide
  MISC_FEATURE (1)..(1): N-terminal acetylation
  MISC_FEATURE (20)..(20): C-terminal amidation
HLYLWQLWPSPWVEVGWEFV

SEQ ID NO: 1360 - protein, 20 aa, Artificial Sequence
  Synthetic peptide
  MISC_FEATURE (1)..(1): N-terminal acetylation
  MISC_FEATURE (20)..(20): C-terminal amidation
HLYLWQRLPSPWVEVGWEFV

SEQ ID NO: 1361 - protein, 20 aa, Artificial Sequence
  Synthetic peptide
  MISC_FEATURE (1)..(1): N-terminal acetylation
  MISC_FEATURE (20)..(20): C-terminal amidation
HLYLWQRWLSPWVEVGWEFV

SEQ ID NO: 1362 - protein, 20 aa, Artificial Sequence
  Synthetic peptide
  MISC_FEATURE (1)..(1): N-terminal acetylation
  MISC_FEATURE (20)..(20): C-terminal amidation
HLYLWQRWPLPWVEVGWEFV

SEQ ID NO: 1363 - protein, 20 aa, Artificial Sequence
  Synthetic peptide
  MISC_FEATURE (1)..(1): N-terminal acetylation
  MISC_FEATURE (20)..(20): C-terminal amidation
HLYLWQRWPSLWVEVGWEFV

SEQ ID NO: 1364 - protein, 20 aa, Artificial Sequence
  Synthetic peptide
  MISC_FEATURE (1)..(1): N-terminal acetylation
  MISC_FEATURE (20)..(20): C-terminal amidation
HLYLWQRWPSPLVEVGWEFV

SEQ ID NO: 1365 - protein, 20 aa, Artificial Sequence
  Synthetic peptide
  MISC_FEATURE (1)..(1): N-terminal acetylation
  MISC_FEATURE (20)..(20): C-terminal amidation
HLYLWQRWPSPWLEVGWEFV

SEQ ID NO: 1366 - protein, 20 aa, Artificial Sequence
  Synthetic peptide
  MISC_FEATURE (1)..(1): N-terminal acetylation
  MISC_FEATURE (20)..(20): C-terminal amidation
HLYLWQRWPSPWVLVGWEFV

SEQ ID NO: 1367 - protein, 20 aa, Artificial Sequence
  Synthetic peptide
  MISC_FEATURE (1)..(1): N-terminal acetylation
  MISC_FEATURE (20)..(20): C-terminal amidation
HLYLWQRWPSPWVELGWEFV

SEQ ID NO: 1368 - protein, 20 aa, Artificial Sequence
  Synthetic peptide
  MISC_FEATURE (1)..(1): N-terminal acetylation
  MISC_FEATURE (20)..(20): C-terminal amidation
HLYLWQRWPSPWVEVLWEFV

SEQ ID NO: 1369 - protein, 20 aa, Artificial Sequence
  Synthetic peptide
  MISC_FEATURE (1)..(1): N-terminal acetylation
  MISC_FEATURE (20)..(20): C-terminal amidation
HLYLWQRWPSPWVEVGLEFV

SEQ ID NO: 1370 - protein, 20 aa, Artificial Sequence
  Synthetic peptide
  MISC_FEATURE (1)..(1): N-terminal acetylation
  MISC_FEATURE (20)..(20): C-terminal amidation
HLYLWQRWPSPWVEVGWLFV

SEQ ID NO: 1371 - protein, 20 aa, Artificial Sequence
  Synthetic peptide
  MISC_FEATURE (1)..(1): N-terminal acetylation
  MISC_FEATURE (20)..(20): C-terminal amidation
HLYLWQRWPSPWVEVGWELV

SEQ ID NO: 1372 - protein, 20 aa, Artificial Sequence
  Synthetic peptide
  MISC_FEATURE (1)..(1): N-terminal acetylation
  MISC_FEATURE (20)..(20): C-terminal amidation
HLYLWQRWPSPWVEVGWEFL

SEQ ID NO: 1373 - protein, 20 aa, Artificial Sequence
  Synthetic peptide
  MISC_FEATURE (1)..(1): N-terminal acetylation
  MISC_FEATURE (20)..(20): C-terminal amidation
SLYLWQRWPSPWVEVGWEFV

SEQ ID NO: 1374 - protein, 20 aa, Artificial Sequence
  Synthetic peptide
  MISC_FEATURE (1)..(1): N-terminal acetylation
  MISC_FEATURE (20)..(20): C-terminal amidation
HSYLWQRWPSPWVEVGWEFV

SEQ ID NO: 1375 - protein, 20 aa, Artificial Sequence
  Synthetic peptide
  MISC_FEATURE (1)..(1): N-terminal acetylation
  MISC_FEATURE (20)..(20): C-terminal amidation
HLSLWQRWPSPWVEVGWEFV

SEQ ID NO: 1376 - protein, 20 aa, Artificial Sequence
  Synthetic peptide
  MISC_FEATURE (1)..(1): N-terminal acetylation
  MISC_FEATURE (20)..(20): C-terminal amidation
HLYSWQRWPSPWVEVGWEFV

SEQ ID NO: 1377 - protein, 20 aa, Artificial Sequence
  Synthetic peptide
  MISC_FEATURE (1)..(1): N-terminal acetylation
  MISC_FEATURE (20)..(20): C-terminal amidation
HLYLSQRWPSPWVEVGWEFV

SEQ ID NO: 1378 - protein, 20 aa, Artificial Sequence
  Synthetic peptide
  MISC_FEATURE (1)..(1): N-terminal acetylation
  MISC_FEATURE (20)..(20): C-terminal amidation
HLYLWSRWPSPWVEVGWEFV

SEQ ID NO: 1379 - protein, 20 aa, Artificial Sequence
  Synthetic peptide
  MISC_FEATURE (1)..(1): N-terminal acetylation
  MISC_FEATURE (20)..(20): C-terminal amidation
HLYLWQSWPSPWVEVGWEFV

SEQ ID NO: 1380 - protein, 20 aa, Artificial Sequence
  Synthetic peptide
  MISC_FEATURE (1)..(1): N-terminal acetylation
  MISC_FEATURE (20)..(20): C-terminal amidation
HLYLWQRSPSPWVEVGWEFV

SEQ ID NO: 1381 - protein, 20 aa, Artificial Sequence
  Synthetic peptide
  MISC_FEATURE (1)..(1): N-terminal acetylation
  MISC_FEATURE (20)..(20): C-terminal amidation
HLYLWQRWSSPWVEVGWEFV

SEQ ID NO: 1382 - protein, 20 aa, Artificial Sequence
  Synthetic peptide
  MISC_FEATURE (1)..(1): N-terminal acetylation
  MISC_FEATURE (20)..(20): C-terminal amidation
HLYLWQRWPSSWVEVGWEFV

SEQ ID NO: 1383 - protein, 20 aa, Artificial Sequence
  Synthetic peptide
  MISC_FEATURE (1)..(1): N-terminal acetylation
  MISC_FEATURE (20)..(20): C-terminal amidation
HLYLWQRWPSPSVEVGWEFV

SEQ ID NO: 1384 - protein, 20 aa, Artificial Sequence
  Synthetic peptide
  MISC_FEATURE (1)..(1): N-terminal acetylation
  MISC_FEATURE (20)..(20): C-terminal amidation
HLYLWQRWPSPWSEVGWEFV

SEQ ID NO: 1385 - protein, 20 aa, Artificial Sequence
  Synthetic peptide
  MISC_FEATURE (1)..(1): N-terminal acetylation
  MISC_FEATURE (20)..(20): C-terminal amidation
HLYLWQRWPSPWVSVGWEFV

SEQ ID NO: 1386 - protein, 20 aa, Artificial Sequence
  Synthetic peptide
  MISC_FEATURE (1)..(1): N-terminal acetylation
  MISC_FEATURE (20)..(20): C-terminal amidation
HLYLWQRWPSPWVESGWEFV

SEQ ID NO: 1387 - protein, 20 aa, Artificial Sequence
  Synthetic peptide
  MISC_FEATURE (1)..(1): N-terminal acetylation
  MISC_FEATURE (20)..(20): C-terminal amidation
HLYLWQRWPSPWVEVSWEFV

SEQ ID NO: 1388 - protein, 20 aa, Artificial Sequence
  Synthetic peptide
  MISC_FEATURE (1)..(1): N-terminal acetylation
  MISC_FEATURE (20)..(20): C-terminal amidation
HLYLWQRWPSPWVEVGSEFV

SEQ ID NO: 1389 - protein, 20 aa, Artificial Sequence
  Synthetic peptide
  MISC_FEATURE (1)..(1): N-terminal acetylation
  MISC_FEATURE (20)..(20): C-terminal amidation
HLYLWQRWPSPWVEVGWSFV

SEQ ID NO: 1390 - protein, 20 aa, Artificial Sequence
  Synthetic peptide
  MISC_FEATURE (1)..(1): N-terminal acetylation
  MISC_FEATURE (20)..(20): C-terminal amidation
HLYLWQRWPSPWVEVGWESV

SEQ ID NO: 1391 - protein, 20 aa, Artificial Sequence
  Synthetic peptide
  MISC_FEATURE (1)..(1): N-terminal acetylation
  MISC_FEATURE (20)..(20): C-terminal amidation
HLYLWQRWPSPWVEVGWEFS

SEQ ID NO: 1392 - protein, 20 aa, Artificial Sequence
  Synthetic peptide
  MISC_FEATURE (1)..(1): N-terminal acetylation
  MISC_FEATURE (20)..(20): C-terminal amidation
PLYLWQRWPSPWVEVGWEFV

SEQ ID NO: 1393 - protein, 20 aa, Artificial Sequence
  Synthetic peptide
  MISC_FEATURE (1)..(1): N-terminal acetylation
  MISC_FEATURE (20)..(20): C-terminal amidation
HPYLWQRWPSPWVEVGWEFV

SEQ ID NO: 1394 - protein, 20 aa, Artificial Sequence
  Synthetic peptide
  MISC_FEATURE (1)..(1): N-terminal acetylation
  MISC_FEATURE (20)..(20): C-terminal amidation
HLPLWQRWPSPWVEVGWEFV

SEQ ID NO: 1395 - protein, 20 aa, Artificial Sequence
  Synthetic peptide
  MISC_FEATURE (1)..(1): N-terminal acetylation
  MISC_FEATURE (20)..(20): C-terminal amidation
HLYPWQRWPSPWVEVGWEFV

SEQ ID NO: 1396 - protein, 20 aa, Artificial Sequence
  Synthetic peptide
  MISC_FEATURE (1)..(1): N-terminal acetylation
  MISC_FEATURE (20)..(20): C-terminal amidation
HLYLPQRWPSPWVEVGWEFV

SEQ ID NO: 1397 - protein, 20 aa, Artificial Sequence
  Synthetic peptide
  MISC_FEATURE (1)..(1): N-terminal acetylation
  MISC_FEATURE (20)..(20): C-terminal amidation
HLYLWPRWPSPWVEVGWEFV

SEQ ID NO: 1398 - protein, 20 aa, Artificial Sequence
  Synthetic peptide
  MISC_FEATURE (1)..(1): N-terminal acetylation
  MISC_FEATURE (20)..(20): C-terminal amidation
HLYLWQPWPSPWVEVGWEFV

SEQ ID NO: 1399 - protein, 20 aa, Artificial Sequence
  Synthetic peptide
  MISC_FEATURE (1)..(1): N-terminal acetylation
  MISC_FEATURE (20)..(20): C-terminal amidation
HLYLWQRPPSPWVEVGWEFV

SEQ ID NO: 1400 - protein, 20 aa, Artificial Sequence
  Synthetic peptide
  MISC_FEATURE (1)..(1): N-terminal acetylation
  MISC_FEATURE (20)..(20): C-terminal amidation
HLYLWQRWPPPWVEVGWEFV

SEQ ID NO: 1401 - protein, 20 aa, Artificial Sequence
  Synthetic peptide
  MISC_FEATURE (1)..(1): N-terminal acetylation
  MISC_FEATURE (20)..(20): C-terminal amidation
HLYLWQRWPSPPVEVGWEFV

SEQ ID NO: 1402 - protein, 20 aa, Artificial Sequence
  Synthetic peptide
  MISC_FEATURE (1)..(1): N-terminal acetylation
  MISC_FEATURE (20)..(20): C-terminal amidation
HLYLWQRWPSPWPEVGWEFV

SEQ ID NO: 1403 - protein, 20 aa, Artificial Sequence
  Synthetic peptide
  MISC_FEATURE (1)..(1): N-terminal acetylation
  MISC_FEATURE (20)..(20): C-terminal amidation
HLYLWQRWPSPWVPVGWEFV

SEQ ID NO: 1404 - protein, 20 aa, Artificial Sequence
  Synthetic peptide
  MISC_FEATURE (1)..(1): N-terminal acetylation
  MISC_FEATURE (20)..(20): C-terminal amidation
HLYLWQRWPSPWVEPGWEFV

SEQ ID NO: 1405 - protein, 20 aa, Artificial Sequence
  Synthetic peptide
  MISC_FEATURE (1)..(1): N-terminal acetylation
  MISC_FEATURE (20)..(20): C-terminal amidation
HLYLWQRWPSPWVEVPWEFV

SEQ ID NO: 1406 - protein, 20 aa, Artificial Sequence
  Synthetic peptide
  MISC_FEATURE (1)..(1): N-terminal acetylation
  MISC_FEATURE (20)..(20): C-terminal amidation
HLYLWQRWPSPWVEVGPEFV

SEQ ID NO: 1407 - protein, 20 aa, Artificial Sequence
  Synthetic peptide
  MISC_FEATURE (1)..(1): N-terminal acetylation
  MISC_FEATURE (20)..(20): C-terminal amidation
HLYLWQRWPSPWVEVGWPFV

SEQ ID NO: 1408 - protein, 20 aa, Artificial Sequence
  Synthetic peptide
  MISC_FEATURE (1)..(1): N-terminal acetylation
  MISC_FEATURE (20)..(20): C-terminal amidation
HLYLWQRWPSPWVEVGWEPV

SEQ ID NO: 1409 - protein, 20 aa, Artificial Sequence
  Synthetic peptide
  MISC_FEATURE (1)..(1): N-terminal acetylation
  MISC_FEATURE (20)..(20): C-terminal amidation
HLYLWQRWPSPWVEVGWEFP

SEQ ID NO: 1410 - protein, 17 aa, Artificial Sequence
  Synthetic peptide
  MISC_FEATURE (1)..(1): N-terminal acetylation
  MISC_FEATURE (17)..(17): C-terminal amidation
HLYLWQRWPSPWVEVGW

SEQ ID NO: 1411 - protein, 14 aa, Artificial Sequence
  Synthetic peptide
  MISC_FEATURE (1)..(1): N-terminal acetylation
  MISC_FEATURE (14)..(14): C-terminal amidation
HLYLWQRWPSPWVE

SEQ ID NO: 1412 - protein, 11 aa, Artificial Sequence
  Synthetic peptide
  MISC_FEATURE (1)..(1): N-terminal acetylation
  MISC_FEATURE (11)..(11): C-terminal amidation
HLYLWQRWPSP

SEQ ID NO: 1413 - protein, 8 aa, Artificial Sequence
  Synthetic peptide
  MISC_FEATURE (1)..(1): N-terminal acetylation
  MISC_FEATURE (8)..(8): C-terminal amidation
HLYLWQRW

SEQ ID NO: 1414 - protein, 17 aa, Artificial Sequence
  Synthetic peptide
  MISC_FEATURE (1)..(1): N-terminal acetylation
  MISC_FEATURE (17)..(17): C-terminal amidation
LWQRWPSPWVEVGWEFV

SEQ ID NO: 1415 - protein, 14 aa, Artificial Sequence
  Synthetic peptide
  MISC_FEATURE (1)..(1): N-terminal acetylation
  MISC_FEATURE (14)..(14): C-terminal amidation
RWPSPWVEVGWEFV

SEQ ID NO: 1416 - protein, 11 aa, Artificial Sequence
  Synthetic peptide
  MISC_FEATURE (1)..(1): N-terminal acetylation
  MISC_FEATURE (11)..(11): C-terminal amidation
SPWVEVGWEFV

SEQ ID NO: 1417 - protein, 8 aa, Artificial Sequence
  Synthetic peptide
  MISC_FEATURE (1)..(1): N-terminal acetylation
  MISC_FEATURE (8)..(8): C-terminal amidation
VEVGWEFV

SEQ ID NO: 1418 - protein, 14 aa, Artificial Sequence
  Synthetic peptide
  MISC_FEATURE (1)..(1): N-terminal acetylation
  MISC_FEATURE (14)..(14): C-terminal amidation
LWQRWPSPWVEVGW

SEQ ID NO: 1419 - protein, 8 aa, Artificial Sequence
  Synthetic peptide
  MISC_FEATURE (1)..(1): N-terminal acetylation
  MISC_FEATURE (8)..(8): C-terminal amidation
RWPSPWVE

SEQ ID NO: 1420 - protein, 20 aa, Artificial Sequence
  Synthetic peptide
  MISC_FEATURE (1)..(1): N-terminal acetylation
  MISC_FEATURE (20)..(20): C-terminal amidation
APTTLIRLGANSWIEIGWEI

SEQ ID NO: 1421 - protein, 20 aa, Artificial Sequence
  Synthetic peptide
  MISC_FEATURE (1)..(1): N-terminal acetylation
  MISC_FEATURE (20)..(20): C-terminal amidation
RATTLIRLGANSWIEIGWEI

SEQ ID NO: 1422 - protein, 20 aa, Artificial Sequence
  Synthetic peptide
  MISC_FEATURE (1)..(1): N-terminal acetylation
  MISC_FEATURE (20)..(20): C-terminal amidation
RPATLIRLGANSWIEIGWEI

SEQ ID NO: 1423 - protein, 20 aa, Artificial Sequence
  Synthetic peptide
  MISC_FEATURE (1)..(1): N-terminal acetylation
  MISC_FEATURE (20)..(20): C-terminal amidation
RPTALIRLGANSWIEIGWEI

SEQ ID NO: 1424 - protein, 20 aa, Artificial Sequence
  Synthetic peptide
  MISC_FEATURE (1)..(1): N-terminal acetylation
  MISC_FEATURE (20)..(20): C-terminal amidation
RPTTAIRLGANSWIEIGWEI

SEQ ID NO: 1425 - protein, 20 aa, Artificial Sequence
  Synthetic peptide
  MISC_FEATURE (1)..(1): N-terminal acetylation
  MISC_FEATURE (20)..(20): C-terminal amidation
RPTTLARLGANSWIEIGWEI

SEQ ID NO: 1426 - protein, 20 aa, Artificial Sequence
  Synthetic peptide
  MISC_FEATURE (1)..(1): N-terminal acetylation
  MISC_FEATURE (20)..(20): C-terminal amidation
RPTTLIALGANSWIEIGWEI

SEQ ID NO: 1427 - protein, 20 aa, Artificial Sequence
  Synthetic peptide
  MISC_FEATURE (1)..(1): N-terminal acetylation
  MISC_FEATURE (20)..(20): C-terminal amidation
RPTTLIRAGANSWIEIGWEI

SEQ ID NO: 1428 - protein, 20 aa, Artificial Sequence
  Synthetic peptide
  MISC_FEATURE (1)..(1): N-terminal acetylation
  MISC_FEATURE (20)..(20): C-terminal amidation
RPTTLIRLAANSWIEIGWEI

SEQ ID NO: 1429 - protein, 20 aa, Artificial Sequence
  Synthetic peptide
  MISC_FEATURE (1)..(1): N-terminal acetylation
  MISC_FEATURE (20)..(20): C-terminal amidation
RPTTLIRLGAASWIEIGWEI

SEQ ID NO: 1430 - protein, 20 aa, Artificial Sequence
  Synthetic peptide
  MISC_FEATURE (1)..(1): N-terminal acetylation
  MISC_FEATURE (20)..(20): C-terminal amidation
RPTTLIRLGANAWIEIGWEI

SEQ ID NO: 1431 - protein, 20 aa, Artificial Sequence
  Synthetic peptide
  MISC_FEATURE (1)..(1): N-terminal acetylation
  MISC_FEATURE (20)..(20): C-terminal amidation
RPTTLIRLGANSAIEIGWEI

SEQ ID NO: 1432 - protein, 20 aa, Artificial Sequence
  Synthetic peptide
  MISC_FEATURE (1)..(1): N-terminal acetylation
  MISC_FEATURE (20)..(20): C-terminal amidation
RPTTLIRLGANSWAEIGWEI

SEQ ID NO: 1433 - protein, 20 aa, Artificial Sequence
  Synthetic peptide
  MISC_FEATURE (1)..(1): N-terminal acetylation
  MISC_FEATURE (20)..(20): C-terminal amidation
RPTTLIRLGANSWIAIGWEI

SEQ ID NO: 1434 - protein, 20 aa, Artificial Sequence
  Synthetic peptide
  MISC_FEATURE (1)..(1): N-terminal acetylation
  MISC_FEATURE (20)..(20): C-terminal amidation
RPTTLIRLGANSWIEAGWEI

SEQ ID NO: 1435 - protein, 20 aa, Artificial Sequence
  Synthetic peptide
  MISC_FEATURE (1)..(1): N-terminal acetylation
  MISC_FEATURE (20)..(20): C-terminal amidation
RPTTLIRLGANSWIEIAWEI

SEQ ID NO: 1436 - protein, 20 aa, Artificial Sequence
  Synthetic peptide
  MISC_FEATURE (1)..(1): N-terminal acetylation
  MISC_FEATURE (20)..(20): C-terminal amidation
RPTTLIRLGANSWIEIGAEI

SEQ ID NO: 1437 - protein, 20 aa, Artificial Sequence
  Synthetic peptide
  MISC_FEATURE (1)..(1): N-terminal acetylation
  MISC_FEATURE (20)..(20): C-terminal amidation
RPTTLIRLGANSWIEIGWAI

SEQ ID NO: 1438 - protein, 20 aa, Artificial Sequence
  Synthetic peptide
  MISC_FEATURE (1)..(1): N-terminal acetylation
  MISC_FEATURE (20)..(20): C-terminal amidation
RPTTLIRLGANSWIEIGWEA

SEQ ID NO: 1439 - protein, 20 aa, Artificial Sequence
  Synthetic peptide
  MISC_FEATURE (1)..(1): N-terminal acetylation
  MISC_FEATURE (20)..(20): C-terminal amidation
DPTTLIRLGANSWIEIGWEI

SEQ ID NO: 1440 - protein, 20 aa, Artificial Sequence
  Synthetic peptide
  MISC_FEATURE (1)..(1): N-terminal acetylation
  MISC_FEATURE (20)..(20): C-terminal amidation
RDTTLIRLGANSWIEIGWEI

SEQ ID NO: 1441 - protein, 20 aa, Artificial Sequence
  Synthetic peptide
  MISC_FEATURE (1)..(1): N-terminal acetylation
  MISC_FEATURE (20)..(20): C-terminal amidation
RPDTLIRLGANSWIEIGWEI

SEQ ID NO: 1442 - protein, 20 aa, Artificial Sequence
  Synthetic peptide
  MISC_FEATURE (1)..(1): N-terminal acetylation
  MISC_FEATURE (20)..(20): C-terminal amidation
RPTDLIRLGANSWIEIGWEI

SEQ ID NO: 1443 - protein, 20 aa, Artificial Sequence
  Synthetic peptide
  MISC_FEATURE (1)..(1): N-terminal acetylation
  MISC_FEATURE (20)..(20): C-terminal amidation
RPTTDIRLGANSWIEIGWEI

SEQ ID NO: 1444 - protein, 20 aa, Artificial Sequence
  Synthetic peptide
  MISC_FEATURE (1)..(1): N-terminal acetylation
  MISC_FEATURE (20)..(20): C-terminal amidation
RPTTLDRLGANSWIEIGWEI

SEQ ID NO: 1445 - protein, 20 aa, Artificial Sequence
  Synthetic peptide
  MISC_FEATURE (1)..(1): N-terminal acetylation
  MISC_FEATURE (20)..(20): C-terminal amidation
RPTTLIDLGANSWIEIGWEI

SEQ ID NO: 1446 - protein, 20 aa, Artificial Sequence
  Synthetic peptide
  MISC_FEATURE (1)..(1): N-terminal acetylation
  MISC_FEATURE (20)..(20): C-terminal amidation
RPTTLIRDGANSWIEIGWEI

SEQ ID NO: 1447 - protein, 20 aa, Artificial Sequence
  Synthetic peptide
  MISC_FEATURE (1)..(1): N-terminal acetylation
  MISC_FEATURE (20)..(20): C-terminal amidation
RPTTLIRLDANSWIEIGWEI

SEQ ID NO: 1448 - protein, 20 aa, Artificial Sequence
  Synthetic peptide
  MISC_FEATURE (1)..(1): N-terminal acetylation
  MISC_FEATURE (20)..(20): C-terminal amidation
RPTTLIRLGDNSWIEIGWEI

SEQ ID NO: 1449 - protein, 20 aa, Artificial Sequence
  Synthetic peptide
  MISC_FEATURE (1)..(1): N-terminal acetylation
  MISC_FEATURE (20)..(20): C-terminal amidation
RPTTLIRLGADSWIEIGWEI

SEQ ID NO: 1450 - protein, 20 aa, Artificial Sequence
  Synthetic peptide
  MISC_FEATURE (1)..(1): N-terminal acetylation
  MISC_FEATURE (20)..(20): C-terminal amidation
RPTTLIRLGANDWIEIGWEI

SEQ ID NO: 1451 - protein, 20 aa, Artificial Sequence
  Synthetic peptide
  MISC_FEATURE (1)..(1): N-terminal acetylation
  MISC_FEATURE (20)..(20): C-terminal amidation
RPTTLIRLGANSDIEIGWEI

SEQ ID NO: 1452 - protein, 20 aa, Artificial Sequence
  Synthetic peptide
  MISC_FEATURE (1)..(1): N-terminal acetylation
  MISC_FEATURE (20)..(20): C-terminal amidation
RPTTLIRLGANSWDEIGWEI

SEQ ID NO: 1453 - protein, 20 aa, Artificial Sequence
  Synthetic peptide
  MISC_FEATURE (1)..(1): N-terminal acetylation
  MISC_FEATURE (20)..(20): C-terminal amidation
RPTTLIRLGANSWIDIGWEI

SEQ ID NO: 1454 - protein, 20 aa, Artificial Sequence
  Synthetic peptide
  MISC_FEATURE (1)..(1): N-terminal acetylation
  MISC_FEATURE (20)..(20): C-terminal amidation
RPTTLIRLGANSWIEDGWEI

SEQ ID NO: 1455 - protein, 20 aa, Artificial Sequence
  Synthetic peptide
  MISC_FEATURE (1)..(1): N-terminal acetylation
  MISC_FEATURE (20)..(20): C-terminal amidation
RPTTLIRLGANSWIEIDWEI

SEQ ID NO: 1456 - protein, 20 aa, Artificial Sequence
  Synthetic peptide
  MISC_FEATURE (1)..(1): N-terminal acetylation
  MISC_FEATURE (20)..(20): C-terminal amidation
RPTTLIRLGANSWIEIGDEI

SEQ ID NO: 1457 - protein, 20 aa, Artificial Sequence
  Synthetic peptide
  MISC_FEATURE (1)..(1): N-terminal acetylation
  MISC_FEATURE (20)..(20): C-terminal amidation
RPTTLIRLGANSWIEIGWDI

SEQ ID NO: 1458 - protein, 20 aa, Artificial Sequence
  Synthetic peptide
  MISC_FEATURE (1)..(1): N-terminal acetylation
  MISC_FEATURE (20)..(20): C-terminal amidation
RPTTLIRLGANSWIEIGWED

SEQ ID NO: 1459 - protein, 20 aa, Artificial Sequence
  Synthetic peptide
  MISC_FEATURE (1)..(1): N-terminal acetylation
  MISC_FEATURE (20)..(20): C-terminal amidation
FPTTLIRLGANSWIEIGWEI

SEQ ID NO: 1460 - protein, 20 aa, Artificial Sequence
  Synthetic peptide
  MISC_FEATURE (1)..(1): N-terminal acetylation
  MISC_FEATURE (20)..(20): C-terminal amidation
RFTTLIRLGANSWIEIGWEI

SEQ ID NO: 1461 - protein, 20 aa, Artificial Sequence
  Synthetic peptide
  MISC_FEATURE (1)..(1): N-terminal acetylation
  MISC_FEATURE (20)..(20): C-terminal amidation
RPFTLIRLGANSWIEIGWEI

SEQ ID NO: 1462 - protein, 20 aa, Artificial Sequence
  Synthetic peptide
  MISC_FEATURE (1)..(1): N-terminal acetylation
  MISC_FEATURE (20)..(20): C-terminal amidation
RPTFLIRLGANSWIEIGWEI

SEQ ID NO: 1463 - protein, 20 aa, Artificial Sequence
  Synthetic peptide
  MISC_FEATURE (1)..(1): N-terminal acetylation
  MISC_FEATURE (20)..(20): C-terminal amidation
RPTTFIRLGANSWIEIGWEI

SEQ ID NO: 1464 - protein, 20 aa, Artificial Sequence
  Synthetic peptide
  MISC_FEATURE (1)..(1): N-terminal acetylation
  MISC_FEATURE (20)..(20): C-terminal amidation
RPTTLFRLGANSWIEIGWEI

SEQ ID NO: 1465 - protein, 20 aa, Artificial Sequence
  Synthetic peptide
  MISC_FEATURE (1)..(1): N-terminal acetylation
  MISC_FEATURE (20)..(20): C-terminal amidation
RPTTLIFLGANSWIEIGWEI

SEQ ID NO: 1466 - protein, 20 aa, Artificial Sequence
  Synthetic peptide
  MISC_FEATURE (1)..(1): N-terminal acetylation
  MISC_FEATURE (20)..(20): C-terminal amidation
RPTTLIRFGANSWIEIGWEI

SEQ ID NO: 1467 - protein, 20 aa, Artificial Sequence
  Synthetic peptide
  MISC_FEATURE (1)..(1): N-terminal acetylation
  MISC_FEATURE (20)..(20): C-terminal amidation
RPTTLIRLFANSWIEIGWEI

SEQ ID NO: 1468 - protein, 20 aa, Artificial Sequence
  Synthetic peptide
  MISC_FEATURE (1)..(1): N-terminal acetylation
  MISC_FEATURE (20)..(20): C-terminal amidation
RPTTLIRLGFNSWIEIGWEI

SEQ ID NO: 1469 - protein, 20 aa, Artificial Sequence
  Synthetic peptide
  MISC_FEATURE (1)..(1): N-terminal acetylation
  MISC_FEATURE (20)..(20): C-terminal amidation
RPTTLIRLGAFSWIEIGWEI

SEQ ID NO: 1470 - protein, 20 aa, Artificial Sequence
  Synthetic peptide
  MISC_FEATURE (1)..(1): N-terminal acetylation
  MISC_FEATURE (20)..(20): C-terminal amidation
RPTTLIRLGANFWIEIGWEI

SEQ ID NO: 1471 - protein, 20 aa, Artificial Sequence
  Synthetic peptide
  MISC_FEATURE (1)..(1): N-terminal acetylation
  MISC_FEATURE (20)..(20): C-terminal amidation
RPTTLIRLGANSFIEIGWEI

SEQ ID NO: 1472 - protein, 20 aa, Artificial Sequence
  Synthetic peptide
  MISC_FEATURE (1)..(1): N-terminal acetylation
  MISC_FEATURE (20)..(20): C-terminal amidation
RPTTLIRLGANSWFEIGWEI

SEQ ID NO: 1473 - protein, 20 aa, Artificial Sequence
  Synthetic peptide
  MISC_FEATURE (1)..(1): N-terminal acetylation
  MISC_FEATURE (20)..(20): C-terminal amidation
RPTTLIRLGANSWIFIGWEI

SEQ ID NO: 1474 - protein, 20 aa, Artificial Sequence
  Synthetic peptide
  MISC_FEATURE (1)..(1): N-terminal acetylation
  MISC_FEATURE (20)..(20): C-terminal amidation
RPTTLIRLGANSWIEFGWEI

SEQ ID NO: 1475 - protein, 20 aa, Artificial Sequence
  Synthetic peptide
  MISC_FEATURE (1)..(1): N-terminal acetylation
  MISC_FEATURE (20)..(20): C-terminal amidation
RPTTLIRLGANSWIEIFWEI

SEQ ID NO: 1476 - protein, 20 aa, Artificial Sequence
  Synthetic peptide
  MISC_FEATURE (1)..(1): N-terminal acetylation
  MISC_FEATURE (20)..(20): C-terminal amidation
RPTTLIRLGANSWIEIGFEI

SEQ ID NO: 1477 - protein, 20 aa, Artificial Sequence
  Synthetic peptide
  MISC_FEATURE (1)..(1): N-terminal acetylation
  MISC_FEATURE (20)..(20): C-terminal amidation
RPTTLIRLGANSWIEIGWFI

SEQ ID NO: 1478 - protein, 20 aa, Artificial Sequence
  Synthetic peptide
  MISC_FEATURE (1)..(1): N-terminal acetylation
  MISC_FEATURE (20)..(20): C-terminal amidation
RPTTLIRLGANSWIEIGWEF

SEQ ID NO: 1479 - protein, 20 aa, Artificial Sequence
  Synthetic peptide
  MISC_FEATURE (1)..(1): N-terminal acetylation
  MISC_FEATURE (20)..(20): C-terminal amidation
GPTTLIRLGANSWIEIGWEI

SEQ ID NO: 1480 - protein, 20 aa, Artificial Sequence
  Synthetic peptide
  MISC_FEATURE (1)..(1): N-terminal acetylation
  MISC_FEATURE (20)..(20): C-terminal amidation
RGTTLIRLGANSWIEIGWEI

SEQ ID NO: 1481 - protein, 20 aa, Artificial Sequence
  Synthetic peptide
  MISC_FEATURE (1)..(1): N-terminal acetylation
  MISC_FEATURE (20)..(20): C-terminal amidation
RPGTLIRLGANSWIEIGWEI

SEQ ID NO: 1482 - protein, 20 aa, Artificial Sequence
  Synthetic peptide
  MISC_FEATURE (1)..(1): N-terminal acetylation
  MISC_FEATURE (20)..(20): C-terminal amidation
RPTGLIRLGANSWIEIGWEI

SEQ ID NO: 1483 - protein, 20 aa, Artificial Sequence
  Synthetic peptide
  MISC_FEATURE (1)..(1): N-terminal acetylation
  MISC_FEATURE (20)..(20): C-terminal amidation
RPTTGIRLGANSWIEIGWEI

SEQ ID NO: 1484 - protein, 20 aa, Artificial Sequence
  Synthetic peptide
  MISC_FEATURE (1)..(1): N-terminal acetylation
  MISC_FEATURE (20)..(20): C-terminal amidation
RPTTLGRLGANSWIEIGWEI

SEQ ID NO: 1485 - protein, 20 aa, Artificial Sequence
  Synthetic peptide
  MISC_FEATURE (1)..(1): N-terminal acetylation
  MISC_FEATURE (20)..(20): C-terminal amidation
RPTTLIGLGANSWIEIGWEI

SEQ ID NO: 1486 - protein, 20 aa, Artificial Sequence
  Synthetic peptide
  MISC_FEATURE (1)..(1): N-terminal acetylation
  MISC_FEATURE (20)..(20): C-terminal amidation
RPTTLIRGGANSWIEIGWEI

SEQ ID NO: 1487 - protein, 20 aa, Artificial Sequence
  Synthetic peptide
  MISC_FEATURE (1)..(1): N-terminal acetylation
  MISC_FEATURE (20)..(20): C-terminal amidation
RPTTLIRLGGNSWIEIGWEI

SEQ ID NO: 1488 - protein, 20 aa, Artificial Sequence
  Synthetic peptide
  MISC_FEATURE (1)..(1): N-terminal acetylation
  MISC_FEATURE (20)..(20): C-terminal amidation
RPTTLIRLGAGSWIEIGWEI

SEQ ID NO: 1489 - protein, 20 aa, Artificial Sequence
  Synthetic peptide
  MISC_FEATURE (1)..(1): N-terminal acetylation
  MISC_FEATURE (20)..(20): C-terminal amidation
RPTTLIRLGANGWIEIGWEI

SEQ ID NO: 1490 - protein, 20 aa, Artificial Sequence
  Synthetic peptide
  MISC_FEATURE (1)..(1): N-terminal acetylation
  MISC_FEATURE (20)..(20): C-terminal amidation
RPTTLIRLGANSGIEIGWEI

SEQ ID NO: 1491 - protein, 20 aa, Artificial Sequence
  Synthetic peptide
  MISC_FEATURE (1)..(1): N-terminal acetylation
  MISC_FEATURE (20)..(20): C-terminal amidation
RPTTLIRLGANSWGEIGWEI

SEQ ID NO: 1492 - protein, 20 aa, Artificial Sequence
  Synthetic peptide
  MISC_FEATURE (1)..(1): N-terminal acetylation
  MISC_FEATURE (20)..(20): C-terminal amidation
RPTTLIRLGANSWIGIGWEI

SEQ ID NO: 1493 - protein, 20 aa, Artificial Sequence
  Synthetic peptide
  MISC_FEATURE (1)..(1): N-terminal acetylation
  MISC_FEATURE (20)..(20): C-terminal amidation
RPTTLIRLGANSWIEGGWEI

SEQ ID NO: 1494 - protein, 20 aa, Artificial Sequence
  Synthetic peptide
  MISC_FEATURE (1)..(1): N-terminal acetylation
  MISC_FEATURE (20)..(20): C-terminal amidation
RPTTLIRLGANSWIEIGGEI

SEQ ID NO: 1495 - protein, 20 aa, Artificial Sequence
  Synthetic peptide
  MISC_FEATURE (1)..(1): N-terminal acetylation
  MISC_FEATURE (20)..(20): C-terminal amidation
RPTTLIRLGANSWIEIGWGI

SEQ ID NO: 1496 - protein, 20 aa, Artificial Sequence
  Synthetic peptide
  MISC_FEATURE (1)..(1): N-terminal acetylation
  MISC_FEATURE (20)..(20): C-terminal amidation
RPTTLIRLGANSWIEIGWEG

SEQ ID NO: 1497 - protein, 20 aa, Artificial Sequence
  Synthetic peptide
  MISC_FEATURE (1)..(1): N-terminal acetylation
  MISC_FEATURE (20)..(20): C-terminal amidation
KPTTLIRLGANSWIEIGWEI

SEQ ID NO: 1498 - protein, 20 aa, Artificial Sequence
  Synthetic peptide
  MISC_FEATURE (1)..(1): N-terminal acetylation
  MISC_FEATURE (20)..(20): C-terminal amidation
RKTTLIRLGANSWIEIGWEI

SEQ ID NO: 1499 - protein, 20 aa, Artificial Sequence
  Synthetic peptide
  MISC_FEATURE (1)..(1): N-terminal acetylation
  MISC_FEATURE (20)..(20): C-terminal amidation
RPKTLIRLGANSWIEIGWEI

SEQ ID NO: 1500 - protein, 20 aa, Artificial Sequence
  Synthetic peptide
  MISC_FEATURE (1)..(1): N-terminal acetylation
  MISC_FEATURE (20)..(20): C-terminal amidation
RPTKLIRLGANSWIEIGWEI

SEQ ID NO: 1501 - protein, 20 aa, Artificial Sequence
  Synthetic peptide
  MISC_FEATURE (1)..(1): N-terminal acetylation
  MISC_FEATURE (20)..(20): C-terminal amidation
RPTTKIRLGANSWIEIGWEI

SEQ ID NO: 1502 - protein, 20 aa, Artificial Sequence
  Synthetic peptide
  MISC_FEATURE (1)..(1): N-terminal acetylation
  MISC_FEATURE (20)..(20): C-terminal amidation
RPTTLKRLGANSWIEIGWEI

SEQ ID NO: 1503 - protein, 20 aa, Artificial Sequence
  Synthetic peptide
  MISC_FEATURE (1)..(1): N-terminal acetylation
  MISC_FEATURE (20)..(20): C-terminal amidation
RPTTLIKLGANSWIEIGWEI

SEQ ID NO: 1504 - protein, 20 aa, Artificial Sequence
  Synthetic peptide
  MISC_FEATURE (1)..(1): N-terminal acetylation
  MISC_FEATURE (20)..(20): C-terminal amidation
RPTTLIRKGANSWIEIGWEI

SEQ ID NO: 1505 - protein, 20 aa, Artificial Sequence
  Synthetic peptide
  MISC_FEATURE (1)..(1): N-terminal acetylation
  MISC_FEATURE (20)..(20): C-terminal amidation
RPTTLIRLKANSWIEIGWEI

SEQ ID NO: 1506 - protein, 20 aa, Artificial Sequence
  Synthetic peptide
  MISC_FEATURE (1)..(1): N-terminal acetylation
  MISC_FEATURE (20)..(20): C-terminal amidation
RPTTLIRLGKNSWIEIGWEI

SEQ ID NO: 1507 - protein, 20 aa, Artificial Sequence
  Synthetic peptide
  MISC_FEATURE (1)..(1): N-terminal acetylation
  MISC_FEATURE (20)..(20): C-terminal amidation
RPTTLIRLGAKSWIEIGWEI

SEQ ID NO: 1508 - protein, 20 aa, Artificial Sequence
  Synthetic peptide
  MISC_FEATURE (1)..(1): N-terminal acetylation
  MISC_FEATURE (20)..(20): C-terminal amidation
RPTTLIRLGANKWIEIGWEI

SEQ ID NO: 1509 - protein, 20 aa, Artificial Sequence
  Synthetic peptide
  MISC_FEATURE (1)..(1): N-terminal acetylation
  MISC_FEATURE (20)..(20): C-terminal amidation
RPTTLIRLGANSKIEIGWEI

SEQ ID NO: 1510 - protein, 20 aa, Artificial Sequence
  Synthetic peptide
  MISC_FEATURE (1)..(1): N-terminal acetylation
  MISC_FEATURE (20)..(20): C-terminal amidation
RPTTLIRLGANSWKEIGWEI

SEQ ID NO: 1511 - protein, 20 aa, Artificial Sequence
  Synthetic peptide
  MISC_FEATURE (1)..(1): N-terminal acetylation
  MISC_FEATURE (20)..(20): C-terminal amidation
RPTTLIRLGANSWIKIGWEI

SEQ ID NO: 1512 - protein, 20 aa, Artificial Sequence
  Synthetic peptide
  MISC_FEATURE (1)..(1): N-terminal acetylation
  MISC_FEATURE (20)..(20): C-terminal amidation
RPTTLIRLGANSWIEKGWEI

SEQ ID NO: 1513 - protein, 20 aa, Artificial Sequence
  Synthetic peptide
  MISC_FEATURE (1)..(1): N-terminal acetylation
  MISC_FEATURE (20)..(20): C-terminal amidation
RPTTLIRLGANSWIEIKWEI

SEQ ID NO: 1514 - protein, 20 aa, Artificial Sequence
  Synthetic peptide
  MISC_FEATURE (1)..(1): N-terminal acetylation
  MISC_FEATURE (20)..(20): C-terminal amidation
RPTTLIRLGANSWIEIGKEI

SEQ ID NO: 1515 - protein, 20 aa, Artificial Sequence
  Synthetic peptide
  MISC_FEATURE (1)..(1): N-terminal acetylation
  MISC_FEATURE (20)..(20): C-terminal amidation
RPTTLIRLGANSWIEIGWKI

SEQ ID NO: 1516 - protein, 20 aa, Artificial Sequence
  Synthetic peptide
  MISC_FEATURE (1)..(1): N-terminal acetylation
  MISC_FEATURE (20)..(20): C-terminal amidation
RPTTLIRLGANSWIEIGWEK

SEQ ID NO: 1517 - protein, 20 aa, Artificial Sequence
  Synthetic peptide
  MISC_FEATURE (1)..(1): N-terminal acetylation
  MISC_FEATURE (20)..(20): C-terminal amidation
LPTTLIRLGANSWIEIGWEI

SEQ ID NO: 1518 - protein, 20 aa, Artificial Sequence
  Synthetic peptide
  MISC_FEATURE (1)..(1): N-terminal acetylation
  MISC_FEATURE (20)..(20): C-terminal amidation
RLTTLIRLGANSWIEIGWEI

SEQ ID NO: 1519 - protein, 20 aa, Artificial Sequence
  Synthetic peptide
  MISC_FEATURE (1)..(1): N-terminal acetylation
  MISC_FEATURE (20)..(20): C-terminal amidation
RPLTLIRLGANSWIEIGWEI

SEQ ID NO: 1520 - protein, 20 aa, Artificial Sequence
  Synthetic peptide
  MISC_FEATURE (1)..(1): N-terminal acetylation
  MISC_FEATURE (20)..(20): C-terminal amidation
RPTLLIRLGANSWIEIGWEI

SEQ ID NO: 1521 - protein, 20 aa, Artificial Sequence
  Synthetic peptide
  MISC_FEATURE (1)..(1): N-terminal acetylation
  MISC_FEATURE (20)..(20): C-terminal amidation
RPTTLLRLGANSWIEIGWEI

SEQ ID NO: 1522 - protein, 20 aa, Artificial Sequence
  Synthetic peptide
  MISC_FEATURE (1)..(1): N-terminal acetylation
  MISC_FEATURE (20)..(20): C-terminal amidation
RPTTLILLGANSWIEIGWEI

SEQ ID NO: 1523 - protein, 20 aa, Artificial Sequence
  Synthetic peptide
  MISC_FEATURE (1)..(1): N-terminal acetylation
  MISC_FEATURE (20)..(20): C-terminal amidation
RPTTLIRLLANSWIEIGWEI

SEQ ID NO: 1524 - protein, 20 aa, Artificial Sequence
  Synthetic peptide
  MISC_FEATURE (1)..(1): N-terminal acetylation
  MISC_FEATURE (20)..(20): C-terminal amidation
RPTTLIRLGLNSWIEIGWEI

SEQ ID NO: 1525 - protein, 20 aa, Artificial Sequence
  Synthetic peptide
  MISC_FEATURE (1)..(1): N-terminal acetylation
  MISC_FEATURE (20)..(20): C-terminal amidation
RPTTLIRLGALSWIEIGWEI

SEQ ID NO: 1526 - protein, 20 aa, Artificial Sequence
  Synthetic peptide
  MISC_FEATURE (1)..(1): N-terminal acetylation
  MISC_FEATURE (20)..(20): C-terminal amidation
RPTTLIRLGANLWIEIGWEI

SEQ ID NO: 1527 - protein, 20 aa, Artificial Sequence
  Synthetic peptide
  MISC_FEATURE (1)..(1): N-terminal acetylation
  MISC_FEATURE (20)..(20): C-terminal amidation
RPTTLIRLGANSLIEIGWEI

SEQ ID NO: 1528 - protein, 20 aa, Artificial Sequence
  Synthetic peptide
  MISC_FEATURE (1)..(1): N-terminal acetylation
  MISC_FEATURE (20)..(20): C-terminal amidation
RPTTLIRLGANSWLEIGWEI

SEQ ID NO: 1529 - protein, 20 aa, Artificial Sequence
  Synthetic peptide
  MISC_FEATURE (1)..(1): N-terminal acetylation
  MISC_FEATURE (20)..(20): C-terminal amidation
RPTTLIRLGANSWILIGWEI

SEQ ID NO: 1530 - protein, 20 aa, Artificial Sequence
  Synthetic peptide
  MISC_FEATURE (1)..(1): N-terminal acetylation
  MISC_FEATURE (20)..(20): C-terminal amidation
RPTTLIRLGANSWIELGWEI

SEQ ID NO: 1531 - protein, 20 aa, Artificial Sequence
  Synthetic peptide
  MISC_FEATURE (1)..(1): N-terminal acetylation
  MISC_FEATURE (20)..(20): C-terminal amidation
RPTTLIRLGANSWIEILWEI

SEQ ID NO: 1532 - protein, 20 aa, Artificial Sequence
  Synthetic peptide
  MISC_FEATURE (1)..(1): N-terminal acetylation
  MISC_FEATURE (20)..(20): C-terminal amidation
RPTTLIRLGANSWIEIGLEI

SEQ ID NO: 1533 - protein, 20 aa, Artificial Sequence
  Synthetic peptide
  MISC_FEATURE (1)..(1): N-terminal acetylation
  MISC_FEATURE (20)..(20): C-terminal amidation
RPTTLIRLGANSWIEIGWLI

SEQ ID NO: 1534 - protein, 20 aa, Artificial Sequence
  Synthetic peptide
  MISC_FEATURE (1)..(1): N-terminal acetylation
  MISC_FEATURE (20)..(20): C-terminal amidation
RPTTLIRLGANSWIEIGWEL

SEQ ID NO: 1535 - protein, 20 aa, Artificial Sequence
  Synthetic peptide
  MISC_FEATURE (1)..(1): N-terminal acetylation
  MISC_FEATURE (20)..(20): C-terminal amidation
SPTTLIRLGANSWIEIGWEI

SEQ ID NO: 1536 - protein, 20 aa, Artificial Sequence
  Synthetic peptide
  MISC_FEATURE (1)..(1): N-terminal acetylation
  MISC_FEATURE (20)..(20): C-terminal amidation
RSTTLIRLGANSWIEIGWEI

SEQ ID NO: 1537 - protein, 20 aa, Artificial Sequence
  Synthetic peptide
  MISC_FEATURE (1)..(1): N-terminal acetylation
  MISC_FEATURE (20)..(20): C-terminal amidation
RPSTLIRLGANSWIEIGWEI

SEQ ID NO: 1538 - protein, 20 aa, Artificial Sequence
  Synthetic peptide
  MISC_FEATURE (1)..(1): N-terminal acetylation
  MISC_FEATURE (20)..(20): C-terminal amidation
RPTSLIRLGANSWIEIGWEI

SEQ ID NO: 1539 - protein, 20 aa, Artificial Sequence
  Synthetic peptide
  MISC_FEATURE (1)..(1): N-terminal acetylation
  MISC_FEATURE (20)..(20): C-terminal amidation
RPTTSIRLGANSWIEIGWEI

SEQ ID NO: 1540 - protein, 20 aa, Artificial Sequence
  Synthetic peptide
  MISC_FEATURE (1)..(1): N-terminal acetylation
  MISC_FEATURE (20)..(20): C-terminal amidation
RPTTLSRLGANSWIEIGWEI

SEQ ID NO: 1541 - protein, 20 aa, Artificial Sequence
  Synthetic peptide
  MISC_FEATURE (1)..(1): N-terminal acetylation
  MISC_FEATURE (20)..(20): C-terminal amidation
RPTTLISLGANSWIEIGWEI

SEQ ID NO: 1542 - protein, 20 aa, Artificial Sequence
  Synthetic peptide
  MISC_FEATURE (1)..(1): N-terminal acetylation
  MISC_FEATURE (20)..(20): C-terminal amidation
RPTTLIRSGANSWIEIGWEI

SEQ ID NO: 1543 - protein, 20 aa, Artificial Sequence
  Synthetic peptide
  MISC_FEATURE (1)..(1): N-terminal acetylation
  MISC_FEATURE (20)..(20): C-terminal amidation
RPTTLIRLSANSWIEIGWEI

SEQ ID NO: 1544 - protein, 20 aa, Artificial Sequence
  Synthetic peptide
  MISC_FEATURE (1)..(1): N-terminal acetylation
  MISC_FEATURE (20)..(20): C-terminal amidation
RPTTLIRLGSNSWIEIGWEI

SEQ ID NO: 1545 - protein, 20 aa, Artificial Sequence
  Synthetic peptide
  MISC_FEATURE (1)..(1): N-terminal acetylation
  MISC_FEATURE (20)..(20): C-terminal amidation
RPTTLIRLGASSWIEIGWEI

SEQ ID NO: 1546 - protein, 20 aa, Artificial Sequence
  Synthetic peptide
  MISC_FEATURE (1)..(1): N-terminal acetylation
  MISC_FEATURE (20)..(20): C-terminal amidation
RPTTLIRLGANSSIEIGWEI

SEQ ID NO: 1547 - protein, 20 aa, Artificial Sequence
  Synthetic peptide
  MISC_FEATURE (1)..(1): N-terminal acetylation
  MISC_FEATURE (20)..(20): C-terminal amidation
RPTTLIRLGANSWSEIGWEI

SEQ ID NO: 1548 - protein, 20 aa, Artificial Sequence
  Synthetic peptide
  MISC_FEATURE (1)..(1): N-terminal acetylation
  MISC_FEATURE (20)..(20): C-terminal amidation
RPTTLIRLGANSWISIGWEI

SEQ ID NO: 1549 - protein, 20 aa, Artificial Sequence
  Synthetic peptide
  MISC_FEATURE (1)..(1): N-terminal acetylation
  MISC_FEATURE (20)..(20): C-terminal amidation
RPTTLIRLGANSWIESGWEI

SEQ ID NO: 1550 - protein, 20 aa, Artificial Sequence
  Synthetic peptide
  MISC_FEATURE (1)..(1): N-terminal acetylation
  MISC_FEATURE (20)..(20): C-terminal amidation
RPTTLIRLGANSWIEISWEI

SEQ ID NO: 1551 - protein, 20 aa, Artificial Sequence
  Synthetic peptide
  MISC_FEATURE (1)..(1): N-terminal acetylation
  MISC_FEATURE (20)..(20): C-terminal amidation
RPTTLIRLGANSWIEIGSEI

SEQ ID NO: 1552 - protein, 20 aa, Artificial Sequence
  Synthetic peptide
  MISC_FEATURE (1)..(1): N-terminal acetylation
  MISC_FEATURE (20)..(20): C-terminal amidation
RPTTLIRLGANSWIEIGWSI

SEQ ID NO: 1553 - protein, 20 aa, Artificial Sequence
  Synthetic peptide
  MISC_FEATURE (1)..(1): N-terminal acetylation
  MISC_FEATURE (20)..(20): C-terminal amidation
RPTTLIRLGANSWIEIGWES

SEQ ID NO: 1554 - protein, 20 aa, Artificial Sequence
  Synthetic peptide
  MISC_FEATURE (1)..(1): N-terminal acetylation
  MISC_FEATURE (20)..(20): C-terminal amidation
PPTTLIRLGANSWIEIGWEI

SEQ ID NO: 1555 - protein, 20 aa, Artificial Sequence
  Synthetic peptide
  MISC_FEATURE (1)..(1): N-terminal acetylation
  MISC_FEATURE (20)..(20): C-terminal amidation
RPPTLIRLGANSWIEIGWEI

SEQ ID NO: 1556 - protein, 20 aa, Artificial Sequence
  Synthetic peptide
  MISC_FEATURE (1)..(1): N-terminal acetylation
  MISC_FEATURE (20)..(20): C-terminal amidation
RPTPLIRLGANSWIEIGWEI

SEQ ID NO: 1557 - protein, 20 aa, Artificial Sequence
  Synthetic peptide
  MISC_FEATURE (1)..(1): N-terminal acetylation
  MISC_FEATURE (20)..(20): C-terminal amidation
RPTTPIRLGANSWIEIGWEI

SEQ ID NO: 1558 - protein, 20 aa, Artificial Sequence
  Synthetic peptide
  MISC_FEATURE (1)..(1): N-terminal acetylation
  MISC_FEATURE (20)..(20): C-terminal amidation
RPTTLPRLGANSWIEIGWEI

SEQ ID NO: 1559 - protein, 20 aa, Artificial Sequence
  Synthetic peptide
  MISC_FEATURE (1)..(1): N-terminal acetylation
  MISC_FEATURE (20)..(20): C-terminal amidation
RPTTLIPLGANSWIEIGWEI

SEQ ID NO: 1560 - protein, 20 aa, Artificial Sequence
  Synthetic peptide
  MISC_FEATURE (1)..(1): N-terminal acetylation
  MISC_FEATURE (20)..(20): C-terminal amidation
RPTTLIRPGANSWIEIGWEI

SEQ ID NO: 1561 - protein, 20 aa, Artificial Sequence
  Synthetic peptide
  MISC_FEATURE (1)..(1): N-terminal acetylation
  MISC_FEATURE (20)..(20): C-terminal amidation
RPTTLIRLPANSWIEIGWEI

SEQ ID NO: 1562 - protein, 20 aa, Artificial Sequence
  Synthetic peptide
  MISC_FEATURE (1)..(1): N-terminal acetylation
  MISC_FEATURE (20)..(20): C-terminal amidation
RPTTLIRLGPNSWIEIGWEI

SEQ ID NO: 1563 - protein, 20 aa, Artificial Sequence
  Synthetic peptide
  MISC_FEATURE (1)..(1): N-terminal acetylation
  MISC_FEATURE (20)..(20): C-terminal amidation
RPTTLIRLGAPSWIEIGWEI

SEQ ID NO: 1564 - protein, 20 aa, Artificial Sequence
  Synthetic peptide
  MISC_FEATURE (1)..(1): N-terminal acetylation
  MISC_FEATURE (20)..(20): C-terminal amidation
RPTTLIRLGANPWIEIGWEI

SEQ ID NO: 1565 - protein, 20 aa, Artificial Sequence
  Synthetic peptide
  MISC_FEATURE (1)..(1): N-terminal acetylation
  MISC_FEATURE (20)..(20): C-terminal amidation
RPTTLIRLGANSPIEIGWEI

SEQ ID NO: 1566 - protein, 20 aa, Artificial Sequence
  Synthetic peptide
  MISC_FEATURE (1)..(1): N-terminal acetylation
  MISC_FEATURE (20)..(20): C-terminal amidation
RPTTLIRLGANSWPEIGWEI

SEQ ID NO: 1567 - protein, 20 aa, Artificial Sequence
  Synthetic peptide
  MISC_FEATURE (1)..(1): N-terminal acetylation
  MISC_FEATURE (20)..(20): C-terminal amidation
RPTTLIRLGANSWIPIGWEI

SEQ ID NO: 1568 - protein, 20 aa, Artificial Sequence
  Synthetic peptide
  MISC_FEATURE (1)..(1): N-terminal acetylation
  MISC_FEATURE (20)..(20): C-terminal amidation
RPTTLIRLGANSWIEPGWEI

SEQ ID NO: 1569 - protein, 20 aa, Artificial Sequence
  Synthetic peptide
  MISC_FEATURE (1)..(1): N-terminal acetylation
  MISC_FEATURE (20)..(20): C-terminal amidation
RPTTLIRLGANSWIEIPWEI

SEQ ID NO: 1570 - protein, 20 aa, Artificial Sequence
  Synthetic peptide
  MISC_FEATURE (1)..(1): N-terminal acetylation
  MISC_FEATURE (20)..(20): C-terminal amidation
RPTTLIRLGANSWIEIGPEI

SEQ ID NO: 1571 - protein, 20 aa, Artificial Sequence
  Synthetic peptide
  MISC_FEATURE (1)..(1): N-terminal acetylation
  MISC_FEATURE (20)..(20): C-terminal amidation
RPTTLIRLGANSWIEIGWPI

SEQ ID NO: 1572 - protein, 20 aa, Artificial Sequence
  Synthetic peptide
  MISC_FEATURE (1)..(1): N-terminal acetylation
  MISC_FEATURE (20)..(20): C-terminal amidation
RPTTLIRLGANSWIEIGWEP

SEQ ID NO: 1573 - protein, 17 aa, Artificial Sequence
  Synthetic peptide
  MISC_FEATURE (1)..(1): N-terminal acetylation
  MISC_FEATURE (17)..(17): C-terminal amidation
RPTTLIRLGANSWIEIG

SEQ ID NO: 1574 - protein, 14 aa, Artificial Sequence
  Synthetic peptide
  MISC_FEATURE (1)..(1): N-terminal acetylation
  MISC_FEATURE (14)..(14): C-terminal amidation
RPTTLIRLGANSWI

SEQ ID NO: 1575 - protein, 11 aa, Artificial Sequence
  Synthetic peptide
  MISC_FEATURE (1)..(1): N-terminal acetylation
  MISC_FEATURE (11)..(11): C-terminal amidation
RPTTLIRLGAN

SEQ ID NO: 1576 - protein, 8 aa, Artificial Sequence
  Synthetic peptide
  MISC_FEATURE (1)..(1): N-terminal acetylation
  MISC_FEATURE (8)..(8): C-terminal amidation
RPTTLIRL

SEQ ID NO: 1577 - protein, 17 aa, Artificial Sequence
  Synthetic peptide
  MISC_FEATURE (1)..(1): N-terminal acetylation
  MISC_FEATURE (17)..(17): C-terminal amidation
TLIRLGANSWIEIGWEI

SEQ ID NO: 1578 - protein, 14 aa, Artificial Sequence
  Synthetic peptide
  MISC_FEATURE (1)..(1): N-terminal acetylation
  MISC_FEATURE (14)..(14): C-terminal amidation
RLGANSWIEIGWEI

SEQ ID NO: 1579 - protein, 11 aa, Artificial Sequence
  Synthetic peptide
  MISC_FEATURE (1)..(1): N-terminal acetylation
  MISC_FEATURE (11)..(11): C-terminal amidation
ANSWIEIGWEI

SEQ ID NO: 1580 - protein, 8 aa, Artificial Sequence
  Synthetic peptide
  MISC_FEATURE (1)..(1): N-terminal acetylation
  MISC_FEATURE (8)..(8): C-terminal amidation
WIEIGWEI

SEQ ID NO: 1581 - protein, 14 aa, Artificial Sequence
  Synthetic peptide
  MISC_FEATURE (1)..(1): N-terminal acetylation
  MISC_FEATURE (14)..(14): C-terminal amidation
TLIRLGANSWIEIG

SEQ ID NO: 1582 - protein, 8 aa, Artificial Sequence
  Synthetic peptide
  MISC_FEATURE (1)..(1): N-terminal acetylation
  MISC_FEATURE (8)..(8): C-terminal amidation
RLGANSWI

SEQ ID NO: 1583 - protein, 20 aa, Artificial Sequence
  Synthetic peptide
  MISC_FEATURE (1)..(1): N-terminal acetylation
  MISC_FEATURE (20)..(20): C-terminal amidation
AKIIVGWELFDTGETTWWKV

SEQ ID NO: 1584 - protein, 20 aa, Artificial Sequence
  Synthetic peptide
  MISC_FEATURE (1)..(1): N-terminal acetylation
  MISC_FEATURE (20)..(20): C-terminal amidation
WAIIVGWELFDTGETTWWKV

SEQ ID NO: 1585 - protein, 20 aa, Artificial Sequence
  Synthetic peptide
  MISC_FEATURE (1)..(1): N-terminal acetylation
  MISC_FEATURE (20)..(20): C-terminal amidation
WKAIVGWELFDTGETTWWKV

SEQ ID NO: 1586 - protein, 20 aa, Artificial Sequence
  Synthetic peptide
  MISC_FEATURE (1)..(1): N-terminal acetylation
  MISC_FEATURE (20)..(20): C-terminal amidation
WKIAVGWELFDTGETTWWKV

SEQ ID NO: 1587 - protein, 20 aa, Artificial Sequence
  Synthetic peptide
  MISC_FEATURE (1)..(1): N-terminal acetylation
  MISC_FEATURE (20)..(20): C-terminal amidation
WKIIAGWELFDTGETTWWKV

SEQ ID NO: 1588 - protein, 20 aa, Artificial Sequence
  Synthetic peptide
  MISC_FEATURE (1)..(1): N-terminal acetylation
  MISC_FEATURE (20)..(20): C-terminal amidation
WKIIVAWELFDTGETTWWKV

SEQ ID NO: 1589 - protein, 20 aa, Artificial Sequence
  Synthetic peptide
  MISC_FEATURE (1)..(1): N-terminal acetylation
  MISC_FEATURE (20)..(20): C-terminal amidation
WKIIVGAELFDTGETTWWKV

SEQ ID NO: 1590 - protein, 20 aa, Artificial Sequence
  Synthetic peptide
  MISC_FEATURE (1)..(1): N-terminal acetylation
  MISC_FEATURE (20)..(20): C-terminal amidation
WKIIVGWALFDTGETTWWKV

SEQ ID NO: 1591 - protein, 20 aa, Artificial Sequence
  Synthetic peptide
  MISC_FEATURE (1)..(1): N-terminal acetylation
  MISC_FEATURE (20)..(20): C-terminal amidation
WKIIVGWEAFDTGETTWWKV

SEQ ID NO: 1592 - protein, 20 aa, Artificial Sequence
  Synthetic peptide
  MISC_FEATURE (1)..(1): N-terminal acetylation
  MISC_FEATURE (20)..(20): C-terminal amidation
WKIIVGWELADTGETTWWKV

SEQ ID NO: 1593 - protein, 20 aa, Artificial Sequence
  Synthetic peptide
  MISC_FEATURE (1)..(1): N-terminal acetylation
  MISC_FEATURE (20)..(20): C-terminal amidation
WKIIVGWELFATGETTWWKV

SEQ ID NO: 1594 - protein, 20 aa, Artificial Sequence
  Synthetic peptide
  MISC_FEATURE (1)..(1): N-terminal acetylation
  MISC_FEATURE (20)..(20): C-terminal amidation
WKIIVGWELFDAGETTWWKV

SEQ ID NO: 1595 - protein, 20 aa, Artificial Sequence
  Synthetic peptide
  MISC_FEATURE (1)..(1): N-terminal acetylation
  MISC_FEATURE (20)..(20): C-terminal amidation
WKIIVGWELFDTAETTWWKV

SEQ ID NO: 1596 - protein, 20 aa, Artificial Sequence
  Synthetic peptide
  MISC_FEATURE (1)..(1): N-terminal acetylation
  MISC_FEATURE (20)..(20): C-terminal amidation
WKIIVGWELFDTGATTWWKV

SEQ ID NO: 1597 - protein, 20 aa, Artificial Sequence
  Synthetic peptide
  MISC_FEATURE (1)..(1): N-terminal acetylation
  MISC_FEATURE (20)..(20): C-terminal amidation
WKIIVGWELFDTGEATWWKV

SEQ ID NO: 1598 - protein, 20 aa, Artificial Sequence
  Synthetic peptide
  MISC_FEATURE (1)..(1): N-terminal acetylation
  MISC_FEATURE (20)..(20): C-terminal amidation
WKIIVGWELFDTGETAWWKV

SEQ ID NO: 1599 - protein, 20 aa, Artificial Sequence
  Synthetic peptide
  MISC_FEATURE (1)..(1): N-terminal acetylation
  MISC_FEATURE (20)..(20): C-terminal amidation
WKIIVGWELFDTGETTAWKV

SEQ ID NO: 1600 - protein, 20 aa, Artificial Sequence
  Synthetic peptide
  MISC_FEATURE (1)..(1): N-terminal acetylation
  MISC_FEATURE (20)..(20): C-terminal amidation
WKIIVGWELFDTGETTWAKV

SEQ ID NO: 1601 - protein, 20 aa, Artificial Sequence
  Synthetic peptide
  MISC_FEATURE (1)..(1): N-terminal acetylation
  MISC_FEATURE (20)..(20): C-terminal amidation
WKIIVGWELFDTGETTWWAV

SEQ ID NO: 1602 - protein, 20 aa, Artificial Sequence
  Synthetic peptide
  MISC_FEATURE (1)..(1): N-terminal acetylation
  MISC_FEATURE (20)..(20): C-terminal amidation
WKIIVGWELFDTGETTWWKA

SEQ ID NO: 1603 - protein, 20 aa, Artificial Sequence
  Synthetic peptide
  MISC_FEATURE (1)..(1): N-terminal acetylation
  MISC_FEATURE (20)..(20): C-terminal amidation
DKIIVGWELFDTGETTWWKV

SEQ ID NO: 1604 - protein, 20 aa, Artificial Sequence
  Synthetic peptide
  MISC_FEATURE (1)..(1): N-terminal acetylation
  MISC_FEATURE (20)..(20): C-terminal amidation
WDIIVGWELFDTGETTWWKV

SEQ ID NO: 1605 - protein, 20 aa, Artificial Sequence
  Synthetic peptide
  MISC_FEATURE (1)..(1): N-terminal acetylation
  MISC_FEATURE (20)..(20): C-terminal amidation
WKDIVGWELFDTGETTWWKV

SEQ ID NO: 1606 - protein, 20 aa, Artificial Sequence
  Synthetic peptide
  MISC_FEATURE (1)..(1): N-terminal acetylation
  MISC_FEATURE (20)..(20): C-terminal amidation
WKIDVGWELFDTGETTWWKV

SEQ ID NO: 1607 - protein, 20 aa, Artificial Sequence
  Synthetic peptide
  MISC_FEATURE (1)..(1): N-terminal acetylation
  MISC_FEATURE (20)..(20): C-terminal amidation
WKIIDGWELFDTGETTWWKV

SEQ ID NO: 1608 - protein, 20 aa, Artificial Sequence
  Synthetic peptide
  MISC_FEATURE (1)..(1): N-terminal acetylation
  MISC_FEATURE (20)..(20): C-terminal amidation
WKIIVDWELFDTGETTWWKV

SEQ ID NO: 1609 - protein, 20 aa, Artificial Sequence
  Synthetic peptide
  MISC_FEATURE (1)..(1): N-terminal acetylation
  MISC_FEATURE (20)..(20): C-terminal amidation
WKIIVGDELFDTGETTWWKV

SEQ ID NO: 1610 - protein, 20 aa, Artificial Sequence
  Synthetic peptide
  MISC_FEATURE (1)..(1): N-terminal acetylation
  MISC_FEATURE (20)..(20): C-terminal amidation
WKIIVGWDLFDTGETTWWKV

SEQ ID NO: 1611 - protein, 20 aa, Artificial Sequence
  Synthetic peptide
  MISC_FEATURE (1)..(1): N-terminal acetylation
  MISC_FEATURE (20)..(20): C-terminal amidation
WKIIVGWEDFDTGETTWWKV

SEQ ID NO: 1612 - protein, 20 aa, Artificial Sequence
  Synthetic peptide
  MISC_FEATURE (1)..(1): N-terminal acetylation
  MISC_FEATURE (20)..(20): C-terminal amidation
WKIIVGWELDDTGETTWWKV

SEQ ID NO: 1613 - protein, 20 aa, Artificial Sequence
  Synthetic peptide
  MISC_FEATURE (1)..(1): N-terminal acetylation
  MISC_FEATURE (20)..(20): C-terminal amidation
WKIIVGWELFDDGETTWWKV

SEQ ID NO: 1614 - protein, 20 aa, Artificial Sequence
  Synthetic peptide
  MISC_FEATURE (1)..(1): N-terminal acetylation
  MISC_FEATURE (20)..(20): C-terminal amidation
WKIIVGWELFDTDETTWWKV

SEQ ID NO: 1615 - protein, 20 aa, Artificial Sequence
  Synthetic peptide
  MISC_FEATURE (1)..(1): N-terminal acetylation
  MISC_FEATURE (20)..(20): C-terminal amidation
WKIIVGWELFDTGDTTWWKV

SEQ ID NO: 1616 - protein, 20 aa, Artificial Sequence
  Synthetic peptide
  MISC_FEATURE (1)..(1): N-terminal acetylation
  MISC_FEATURE (20)..(20): C-terminal amidation
WKIIVGWELFDTGEDTWWKV

SEQ ID NO: 1617 - protein, 20 aa, Artificial Sequence
  Synthetic peptide
  MISC_FEATURE (1)..(1): N-terminal acetylation
  MISC_FEATURE (20)..(20): C-terminal amidation
WKIIVGWELFDTGETDWWKV

SEQ ID NO: 1618 - protein, 20 aa, Artificial Sequence
  Synthetic peptide
  MISC_FEATURE (1)..(1): N-terminal acetylation
  MISC_FEATURE (20)..(20): C-terminal amidation
WKIIVGWELFDTGETTDWKV

SEQ ID NO: 1619 - protein, 20 aa, Artificial Sequence
  Synthetic peptide
  MISC_FEATURE (1)..(1): N-terminal acetylation
  MISC_FEATURE (20)..(20): C-terminal amidation
WKIIVGWELFDTGETTWDKV

SEQ ID NO: 1620 - protein, 20 aa, Artificial Sequence
  Synthetic peptide
  MISC_FEATURE (1)..(1): N-terminal acetylation
  MISC_FEATURE (20)..(20): C-terminal amidation
WKIIVGWELFDTGETTWWDV

SEQ ID NO: 1621 - protein, 20 aa, Artificial Sequence
  Synthetic peptide
  MISC_FEATURE (1)..(1): N-terminal acetylation
  MISC_FEATURE (20)..(20): C-terminal amidation
WKIIVGWELFDTGETTWWKD

SEQ ID NO: 1622 - protein, 20 aa, Artificial Sequence
  Synthetic peptide
  MISC_FEATURE (1)..(1): N-terminal acetylation
  MISC_FEATURE (20)..(20): C-terminal amidation
FKIIVGWELFDTGETTWWKV

SEQ ID NO: 1623 - protein, 20 aa, Artificial Sequence
  Synthetic peptide
  MISC_FEATURE (1)..(1): N-terminal acetylation
  MISC_FEATURE (20)..(20): C-terminal amidation
WFIIVGWELFDTGETTWWKV

SEQ ID NO: 1624 - protein, 20 aa, Artificial Sequence
  Synthetic peptide
  MISC_FEATURE (1)..(1): N-terminal acetylation
  MISC_FEATURE (20)..(20): C-terminal amidation
WKFIVGWELFDTGETTWWKV

SEQ ID NO: 1625 - protein, 20 aa, Artificial Sequence
  Synthetic peptide
  MISC_FEATURE (1)..(1): N-terminal acetylation
  MISC_FEATURE (20)..(20): C-terminal amidation
WKIFVGWELFDTGETTWWKV

SEQ ID NO: 1626 - protein, 20 aa, Artificial Sequence
  Synthetic peptide
  MISC_FEATURE (1)..(1): N-terminal acetylation
  MISC_FEATURE (20)..(20): C-terminal amidation
WKIIFGWELFDTGETTWWKV

SEQ ID NO: 1627 - protein, 20 aa, Artificial Sequence
  Synthetic peptide
  MISC_FEATURE (1)..(1): N-terminal acetylation
  MISC_FEATURE (20)..(20): C-terminal amidation
WKIIVFWELFDTGETTWWKV

SEQ ID NO: 1628 - protein, 20 aa, Artificial Sequence
  Synthetic peptide
  MISC_FEATURE (1)..(1): N-terminal acetylation
  MISC_FEATURE (20)..(20): C-terminal amidation
WKIIVGFELFDTGETTWWKV

SEQ ID NO: 1629 - protein, 20 aa, Artificial Sequence
  Synthetic peptide
  MISC_FEATURE (1)..(1): N-terminal acetylation
  MISC_FEATURE (20)..(20): C-terminal amidation
WKIIVGWFLFDTGETTWWKV

SEQ ID NO: 1630 - protein, 20 aa, Artificial Sequence
  Synthetic peptide
  MISC_FEATURE (1)..(1): N-terminal acetylation
  MISC_FEATURE (20)..(20): C-terminal amidation
WKIIVGWEFFDTGETTWWKV

SEQ ID NO: 1631 - protein, 20 aa, Artificial Sequence
  Synthetic peptide
  MISC_FEATURE (1)..(1): N-terminal acetylation
  MISC_FEATURE (20)..(20): C-terminal amidation
WKIIVGWELFFTGETTWWKV

SEQ ID NO: 1632 - protein, 20 aa, Artificial Sequence
  Synthetic peptide
  MISC_FEATURE (1)..(1): N-terminal acetylation
  MISC_FEATURE (20)..(20): C-terminal amidation
WKIIVGWELFDFGETTWWKV

SEQ ID NO: 1633 - protein, 20 aa, Artificial Sequence
  Synthetic peptide
  MISC_FEATURE (1)..(1): N-terminal acetylation
  MISC_FEATURE (20)..(20): C-terminal amidation
WKIIVGWELFDTFETTWWKV

SEQ ID NO: 1634 - protein, 20 aa, Artificial Sequence
  Synthetic peptide
  MISC_FEATURE (1)..(1): N-terminal acetylation
  MISC_FEATURE (20)..(20): C-terminal amidation
WKIIVGWELFDTGFTTWWKV

SEQ ID NO: 1635 - protein, 20 aa, Artificial Sequence
  Synthetic peptide
  MISC_FEATURE (1)..(1): N-terminal acetylation
  MISC_FEATURE (20)..(20): C-terminal amidation
WKIIVGWELFDTGEFTWWKV

SEQ ID NO: 1636 - protein, 20 aa, Artificial Sequence
  Synthetic peptide
  MISC_FEATURE (1)..(1): N-terminal acetylation
  MISC_FEATURE (20)..(20): C-terminal amidation
WKIIVGWELFDTGETFWWKV

SEQ ID NO: 1637 - protein, 20 aa, Artificial Sequence
  Synthetic peptide
  MISC_FEATURE (1)..(1): N-terminal acetylation
  MISC_FEATURE (20)..(20): C-terminal amidation
WKIIVGWELFDTGETTFWKV

SEQ ID NO: 1638 - protein, 20 aa, Artificial Sequence
  Synthetic peptide
  MISC_FEATURE (1)..(1): N-terminal acetylation
  MISC_FEATURE (20)..(20): C-terminal amidation
WKIIVGWELFDTGETTWFKV

SEQ ID NO: 1639 - protein, 20 aa, Artificial Sequence
  Synthetic peptide
  MISC_FEATURE (1)..(1): N-terminal acetylation
  MISC_FEATURE (20)..(20): C-terminal amidation
WKIIVGWELFDTGETTWWFV

SEQ ID NO: 1640 - protein, 20 aa, Artificial Sequence
  Synthetic peptide
  MISC_FEATURE (1)..(1): N-terminal acetylation
  MISC_FEATURE (20)..(20): C-terminal amidation
WKIIVGWELFDTGETTWWKF

SEQ ID NO: 1641 - protein, 20 aa, Artificial Sequence
  Synthetic peptide
  MISC_FEATURE (1)..(1): N-terminal acetylation
  MISC_FEATURE (20)..(20): C-terminal amidation
GKIIVGWELFDTGETTWWKV

SEQ ID NO: 1642 - protein, 20 aa, Artificial Sequence
  Synthetic peptide
  MISC_FEATURE (1)..(1): N-terminal acetylation
  MISC_FEATURE (20)..(20): C-terminal amidation
WGIIVGWELFDTGETTWWKV

SEQ ID NO: 1643 - protein, 20 aa, Artificial Sequence
  Synthetic peptide
  MISC_FEATURE (1)..(1): N-terminal acetylation
  MISC_FEATURE (20)..(20): C-terminal amidation
WKGIVGWELFDTGETTWWKV

SEQ ID NO: 1644 - protein, 20 aa, Artificial Sequence
  Synthetic peptide
  MISC_FEATURE (1)..(1): N-terminal acetylation
  MISC_FEATURE (20)..(20): C-terminal amidation
WKIGVGWELFDTGETTWWKV

SEQ ID NO: 1645 - protein, 20 aa, Artificial Sequence
  Synthetic peptide
  MISC_FEATURE (1)..(1): N-terminal acetylation
  MISC_FEATURE (20)..(20): C-terminal amidation
WKIIGGWELFDTGETTWWKV

SEQ ID NO: 1646 - protein, 20 aa, Artificial Sequence
  Synthetic peptide
  MISC_FEATURE (1)..(1): N-terminal acetylation
  MISC_FEATURE (20)..(20): C-terminal amidation
WKIIVGGELFDTGETTWWKV

SEQ ID NO: 1647 - protein, 20 aa, Artificial Sequence
  Synthetic peptide
  MISC_FEATURE (1)..(1): N-terminal acetylation
  MISC_FEATURE (20)..(20): C-terminal amidation
WKIIVGWGLFDTGETTWWKV

SEQ ID NO: 1648 - protein, 20 aa, Artificial Sequence
  Synthetic peptide
  MISC_FEATURE (1)..(1): N-terminal acetylation
  MISC_FEATURE (20)..(20): C-terminal amidation
WKIIVGWEGFDTGETTWWKV

SEQ ID NO: 1649 - protein, 20 aa, Artificial Sequence
  Synthetic peptide
  MISC_FEATURE (1)..(1): N-terminal acetylation
  MISC_FEATURE (20)..(20): C-terminal amidation
WKIIVGWELGDTGETTWWKV

SEQ ID NO: 1650 - protein, 20 aa, Artificial Sequence
  Synthetic peptide
  MISC_FEATURE (1)..(1): N-terminal acetylation
  MISC_FEATURE (20)..(20): C-terminal amidation
WKIIVGWELFGTGETTWWKV

SEQ ID NO: 1651 - protein, 20 aa, Artificial Sequence
  Synthetic peptide
  MISC_FEATURE (1)..(1): N-terminal acetylation
  MISC_FEATURE (20)..(20): C-terminal amidation
WKIIVGWELFDGGETTWWKV

SEQ ID NO: 1652 - protein, 20 aa, Artificial Sequence
  Synthetic peptide
  MISC_FEATURE (1)..(1): N-terminal acetylation
  MISC_FEATURE (20)..(20): C-terminal amidation
WKIIVGWELFDTGGTTWWKV

SEQ ID NO: 1653 - protein, 20 aa, Artificial Sequence
  Synthetic peptide
  MISC_FEATURE (1)..(1): N-terminal acetylation
  MISC_FEATURE (20)..(20): C-terminal amidation
WKIIVGWELFDTGEGTWWKV

SEQ ID NO: 1654 - protein, 20 aa, Artificial Sequence
  Synthetic peptide
  MISC_FEATURE (1)..(1): N-terminal acetylation
  MISC_FEATURE (20)..(20): C-terminal amidation
WKIIVGWELFDTGETGWWKV

SEQ ID NO: 1655 - protein, 20 aa, Artificial Sequence
  Synthetic peptide
  MISC_FEATURE (1)..(1): N-terminal acetylation
  MISC_FEATURE (20)..(20): C-terminal amidation
WKIIVGWELFDTGETTGWKV

SEQ ID NO: 1656 - protein, 20 aa, Artificial Sequence
  Synthetic peptide
  MISC_FEATURE (1)..(1): N-terminal acetylation
  MISC_FEATURE (20)..(20): C-terminal amidation
WKIIVGWELFDTGETTWGKV

SEQ ID NO: 1657 - protein, 20 aa, Artificial Sequence
  Synthetic peptide
  MISC_FEATURE (1)..(1): N-terminal acetylation
  MISC_FEATURE (20)..(20): C-terminal amidation
WKIIVGWELFDTGETTWWGV

SEQ ID NO: 1658 - protein, 20 aa, Artificial Sequence
  Synthetic peptide
  MISC_FEATURE (1)..(1): N-terminal acetylation
  MISC_FEATURE (20)..(20): C-terminal amidation
WKIIVGWELFDTGETTWWKG

SEQ ID NO: 1659 - protein, 20 aa, Artificial Sequence
  Synthetic peptide
  MISC_FEATURE (1)..(1): N-terminal acetylation
  MISC_FEATURE (20)..(20): C-terminal amidation
KKIIVGWELFDTGETTWWKV

SEQ ID NO: 1660 - protein, 20 aa, Artificial Sequence
  Synthetic peptide
  MISC_FEATURE (1)..(1): N-terminal acetylation
  MISC_FEATURE (20)..(20): C-terminal amidation
WKKIVGWELFDTGETTWWKV

SEQ ID NO: 1661 - protein, 20 aa, Artificial Sequence
  Synthetic peptide
  MISC_FEATURE (1)..(1): N-terminal acetylation
  MISC_FEATURE (20)..(20): C-terminal amidation
WKIKVGWELFDTGETTWWKV

SEQ ID NO: 1662 - protein, 20 aa, Artificial Sequence
  Synthetic peptide
  MISC_FEATURE (1)..(1): N-terminal acetylation
  MISC_FEATURE (20)..(20): C-terminal amidation
WKIIKGWELFDTGETTWWKV

SEQ ID NO: 1663 - protein, 20 aa, Artificial Sequence
  Synthetic peptide
  MISC_FEATURE (1)..(1): N-terminal acetylation
  MISC_FEATURE (20)..(20): C-terminal amidation
WKIIVKWELFDTGETTWWKV

SEQ ID NO: 1664 - protein, 20 aa, Artificial Sequence
  Synthetic peptide
  MISC_FEATURE (1)..(1): N-terminal acetylation
  MISC_FEATURE (20)..(20): C-terminal amidation
WKIIVGKELFDTGETTWWKV

SEQ ID NO: 1665 - protein, 20 aa, Artificial Sequence
  Synthetic peptide
  MISC_FEATURE (1)..(1): N-terminal acetylation
  MISC_FEATURE (20)..(20): C-terminal amidation
WKIIVGWKLFDTGETTWWKV

SEQ ID NO: 1666 - protein, 20 aa, Artificial Sequence
  Synthetic peptide
  MISC_FEATURE (1)..(1): N-terminal acetylation
  MISC_FEATURE (20)..(20): C-terminal amidation
WKIIVGWEKFDTGETTWWKV

SEQ ID NO: 1667 - protein, 20 aa, Artificial Sequence
  Synthetic peptide
  MISC_FEATURE (1)..(1): N-terminal acetylation
  MISC_FEATURE (20)..(20): C-terminal amidation
WKIIVGWELKDTGETTWWKV

SEQ ID NO: 1668 - protein, 20 aa, Artificial Sequence
  Synthetic peptide
  MISC_FEATURE (1)..(1): N-terminal acetylation
  MISC_FEATURE (20)..(20): C-terminal amidation
WKIIVGWELFKTGETTWWKV

SEQ ID NO: 1669 - protein, 20 aa, Artificial Sequence
  Synthetic peptide
  MISC_FEATURE (1)..(1): N-terminal acetylation
  MISC_FEATURE (20)..(20): C-terminal amidation
WKIIVGWELFDKGETTWWKV

SEQ ID NO: 1670 - protein, 20 aa, Artificial Sequence
  Synthetic peptide
  MISC_FEATURE (1)..(1): N-terminal acetylation
  MISC_FEATURE (20)..(20): C-terminal amidation
WKIIVGWELFDTKETTWWKV

SEQ ID NO: 1671 - protein, 20 aa, Artificial Sequence
  Synthetic peptide
  MISC_FEATURE (1)..(1): N-terminal acetylation
  MISC_FEATURE (20)..(20): C-terminal amidation
WKIIVGWELFDTGKTTWWKV

SEQ ID NO: 1672 - protein, 20 aa, Artificial Sequence
  Synthetic peptide
  MISC_FEATURE (1)..(1): N-terminal acetylation
  MISC_FEATURE (20)..(20): C-terminal amidation
WKIIVGWELFDTGEKTWWKV

SEQ ID NO: 1673 - protein, 20 aa, Artificial Sequence
  Synthetic peptide
  MISC_FEATURE (1)..(1): N-terminal acetylation
  MISC_FEATURE (20)..(20): C-terminal amidation
WKIIVGWELFDTGETKWWKV

SEQ ID NO: 1674 - protein, 20 aa, Artificial Sequence
  Synthetic peptide
  MISC_FEATURE (1)..(1): N-terminal acetylation
  MISC_FEATURE (20)..(20): C-terminal amidation
WKIIVGWELFDTGETTKWKV

SEQ ID NO: 1675 - protein, 20 aa, Artificial Sequence
  Synthetic peptide
  MISC_FEATURE (1)..(1): N-terminal acetylation
  MISC_FEATURE (20)..(20): C-terminal amidation
WKIIVGWELFDTGETTWKKV

SEQ ID NO: 1676 - protein, 20 aa, Artificial Sequence
  Synthetic peptide
  MISC_FEATURE (1)..(1): N-terminal acetylation
  MISC_FEATURE (20)..(20): C-terminal amidation
WKIIVGWELFDTGETTWWKK

SEQ ID NO: 1677 - protein, 20 aa, Artificial Sequence
  Synthetic peptide
  MISC_FEATURE (1)..(1): N-terminal acetylation
  MISC_FEATURE (20)..(20): C-terminal amidation
LKIIVGWELFDTGETTWWKV

SEQ ID NO: 1678 - protein, 20 aa, Artificial Sequence
  Synthetic peptide
  MISC_FEATURE (1)..(1): N-terminal acetylation
  MISC_FEATURE (20)..(20): C-terminal amidation
WLIIVGWELFDTGETTWWKV

SEQ ID NO: 1679 - protein, 20 aa, Artificial Sequence
  Synthetic peptide
  MISC_FEATURE (1)..(1): N-terminal acetylation
  MISC_FEATURE (20)..(20): C-terminal amidation
WKLIVGWELFDTGETTWWKV

SEQ ID NO: 1680 - protein, 20 aa, Artificial Sequence
  Synthetic peptide
  MISC_FEATURE (1)..(1): N-terminal acetylation
  MISC_FEATURE (20)..(20): C-terminal amidation
WKILVGWELFDTGETTWWKV

SEQ ID NO: 1681 - protein, 20 aa, Artificial Sequence
  Synthetic peptide
  MISC_FEATURE (1)..(1): N-terminal acetylation
  MISC_FEATURE (20)..(20): C-terminal amidation
WKIILGWELFDTGETTWWKV

SEQ ID NO: 1682 - protein, 20 aa, Artificial Sequence
  Synthetic peptide
  MISC_FEATURE (1)..(1): N-terminal acetylation
  MISC_FEATURE (20)..(20): C-terminal amidation
WKIIVLWELFDTGETTWWKV

SEQ ID NO: 1683 - protein, 20 aa, Artificial Sequence
  Synthetic peptide
  MISC_FEATURE (1)..(1): N-terminal acetylation
  MISC_FEATURE (20)..(20): C-terminal amidation
WKIIVGLELFDTGETTWWKV

SEQ ID NO: 1684 - protein, 20 aa, Artificial Sequence
  Synthetic peptide
  MISC_FEATURE (1)..(1): N-terminal acetylation
  MISC_FEATURE (20)..(20): C-terminal amidation
WKIIVGWLLFDTGETTWWKV

SEQ ID NO: 1685 - protein, 20 aa, Artificial Sequence
  Synthetic peptide
  MISC_FEATURE (1)..(1): N-terminal acetylation
  MISC_FEATURE (20)..(20): C-terminal amidation
WKIIVGWELLDTGETTWWKV

SEQ ID NO: 1686 - protein, 20 aa, Artificial Sequence
  Synthetic peptide
  MISC_FEATURE (1)..(1): N-terminal acetylation
  MISC_FEATURE (20)..(20): C-terminal amidation
WKIIVGWELFLTGETTWWKV

SEQ ID NO: 1687 - protein, 20 aa, Artificial Sequence
  Synthetic peptide
  MISC_FEATURE (1)..(1): N-terminal acetylation
  MISC_FEATURE (20)..(20): C-terminal amidation
WKIIVGWELFDLGETTWWKV

SEQ ID NO: 1688 - protein, 20 aa, Artificial Sequence
  Synthetic peptide
  MISC_FEATURE (1)..(1): N-terminal acetylation
  MISC_FEATURE (20)..(20): C-terminal amidation
WKIIVGWELFDTLETTWWKV

SEQ ID NO: 1689 - protein, 20 aa, Artificial Sequence
  Synthetic peptide
  MISC_FEATURE (1)..(1): N-terminal acetylation
  MISC_FEATURE (20)..(20): C-terminal amidation
WKIIVGWELFDTGLTTWWKV

SEQ ID NO: 1690 - protein, 20 aa, Artificial Sequence
  Synthetic peptide
  MISC_FEATURE (1)..(1): N-terminal acetylation
  MISC_FEATURE (20)..(20): C-terminal amidation
WKIIVGWELFDTGELTWWKV

SEQ ID NO: 1691 - protein, 20 aa, Artificial Sequence
  Synthetic peptide
  MISC_FEATURE (1)..(1): N-terminal acetylation
  MISC_FEATURE (20)..(20): C-terminal amidation
WKIIVGWELFDTGETLWWKV

SEQ ID NO: 1692 - protein, 20 aa, Artificial Sequence
  Synthetic peptide
  MISC_FEATURE (1)..(1): N-terminal acetylation
  MISC_FEATURE (20)..(20): C-terminal amidation
WKIIVGWELFDTGETTLWKV

SEQ ID NO: 1693 - protein, 20 aa, Artificial Sequence
  Synthetic peptide
  MISC_FEATURE (1)..(1): N-terminal acetylation
  MISC_FEATURE (20)..(20): C-terminal amidation
WKIIVGWELFDTGETTWLKV

SEQ ID NO: 1694 - protein, 20 aa, Artificial Sequence
  Synthetic peptide
  MISC_FEATURE (1)..(1): N-terminal acetylation
  MISC_FEATURE (20)..(20): C-terminal amidation
WKIIVGWELFDTGETTWWLV

SEQ ID NO: 1695 - protein, 20 aa, Artificial Sequence
  Synthetic peptide
  MISC_FEATURE (1)..(1): N-terminal acetylation
  MISC_FEATURE (20)..(20): C-terminal amidation
WKIIVGWELFDTGETTWWKL

SEQ ID NO: 1696 - protein, 20 aa, Artificial Sequence
  Synthetic peptide
  MISC_FEATURE (1)..(1): N-terminal acetylation
  MISC_FEATURE (20)..(20): C-terminal amidation
SKIIVGWELFDTGETTWWKV

SEQ ID NO: 1697 - protein, 20 aa, Artificial Sequence
  Synthetic peptide
  MISC_FEATURE (1)..(1): N-terminal acetylation
  MISC_FEATURE (20)..(20): C-terminal amidation
WSIIVGWELFDTGETTWWKV

SEQ ID NO: 1698 - protein, 20 aa, Artificial Sequence
  Synthetic peptide
  MISC_FEATURE (1)..(1): N-terminal acetylation
  MISC_FEATURE (20)..(20): C-terminal amidation
WKSIVGWELFDTGETTWWKV

SEQ ID NO: 1699 - protein, 20 aa, Artificial Sequence
  Synthetic peptide
  MISC_FEATURE (1)..(1): N-terminal acetylation
  MISC_FEATURE (20)..(20): C-terminal amidation
WKISVGWELFDTGETTWWKV

SEQ ID NO: 1700 - protein, 20 aa, Artificial Sequence
  Synthetic peptide
  MISC_FEATURE (1)..(1): N-terminal acetylation
  MISC_FEATURE (20)..(20): C-terminal amidation
WKIISGWELFDTGETTWWKV

SEQ ID NO: 1701 - protein, 20 aa, Artificial Sequence
  Synthetic peptide
  MISC_FEATURE (1)..(1): N-terminal acetylation
  MISC_FEATURE (20)..(20): C-terminal amidation
WKIIVSWELFDTGETTWWKV

SEQ ID NO: 1702 - protein, 20 aa, Artificial Sequence
  Synthetic peptide
  MISC_FEATURE (1)..(1): N-terminal acetylation
  MISC_FEATURE (20)..(20): C-terminal amidation
WKIIVGSELFDTGETTWWKV

SEQ ID NO: 1703 - protein, 20 aa, Artificial Sequence
  Synthetic peptide
  MISC_FEATURE (1)..(1): N-terminal acetylation
  MISC_FEATURE (20)..(20): C-terminal amidation
WKIIVGWSLFDTGETTWWKV

SEQ ID NO: 1704 - protein, 20 aa, Artificial Sequence
  Synthetic peptide
  MISC_FEATURE (1)..(1): N-terminal acetylation
  MISC_FEATURE (20)..(20): C-terminal amidation
WKIIVGWESFDTGETTWWKV

SEQ ID NO: 1705 - protein, 20 aa, Artificial Sequence
  Synthetic peptide
  MISC_FEATURE (1)..(1): N-terminal acetylation
  MISC_FEATURE (20)..(20): C-terminal amidation
WKIIVGWELSDTGETTWWKV

SEQ ID NO: 1706 - protein, 20 aa, Artificial Sequence
  Synthetic peptide
  MISC_FEATURE (1)..(1): N-terminal acetylation
  MISC_FEATURE (20)..(20): C-terminal amidation
WKIIVGWELFSTGETTWWKV

SEQ ID NO: 1707 - protein, 20 aa, Artificial Sequence
  Synthetic peptide
  MISC_FEATURE (1)..(1): N-terminal acetylation
  MISC_FEATURE (20)..(20): C-terminal amidation
WKIIVGWELFDSGETTWWKV

SEQ ID NO: 1708 - protein, 20 aa, Artificial Sequence
  Synthetic peptide
  MISC_FEATURE (1)..(1): N-terminal acetylation
  MISC_FEATURE (20)..(20): C-terminal amidation
WKIIVGWELFDTSETTWWKV

SEQ ID NO: 1709 - protein, 20 aa, Artificial Sequence
  Synthetic peptide
  MISC_FEATURE (1)..(1): N-terminal acetylation
  MISC_FEATURE (20)..(20): C-terminal amidation
WKIIVGWELFDTGSTTWWKV

SEQ ID NO: 1710 - protein, 20 aa, Artificial Sequence
  Synthetic peptide
  MISC_FEATURE (1)..(1): N-terminal acetylation
  MISC_FEATURE (20)..(20): C-terminal amidation
WKIIVGWELFDTGESTWWKV

SEQ ID NO: 1711 - protein, 20 aa, Artificial Sequence
  Synthetic peptide
  MISC_FEATURE (1)..(1): N-terminal acetylation
  MISC_FEATURE (20)..(20): C-terminal amidation
WKIIVGWELFDTGETSWWKV

SEQ ID NO: 1712 - protein, 20 aa, Artificial Sequence
  Synthetic peptide
  MISC_FEATURE (1)..(1): N-terminal acetylation
  MISC_FEATURE (20)..(20): C-terminal amidation
WKIIVGWELFDTGETTSWKV

SEQ ID NO: 1713 - protein, 20 aa, Artificial Sequence
  Synthetic peptide
  MISC_FEATURE (1)..(1): N-terminal acetylation
  MISC_FEATURE (20)..(20): C-terminal amidation
WKIIVGWELFDTGETTWSKV

SEQ ID NO: 1714 - protein, 20 aa, Artificial Sequence
  Synthetic peptide
  MISC_FEATURE (1)..(1): N-terminal acetylation
  MISC_FEATURE (20)..(20): C-terminal amidation
WKIIVGWELFDTGETTWWSV

SEQ ID NO: 1715 - protein, 20 aa, Artificial Sequence
  Synthetic peptide
  MISC_FEATURE (1)..(1): N-terminal acetylation
  MISC_FEATURE (20)..(20): C-terminal amidation
WKIIVGWELFDTGETTWWKS

SEQ ID NO: 1716 - protein, 20 aa, Artificial Sequence
  Synthetic peptide
  MISC_FEATURE (1)..(1): N-terminal acetylation
  MISC_FEATURE (20)..(20): C-terminal amidation
PKIIVGWELFDTGETTWWKV

SEQ ID NO: 1717 - protein, 20 aa, Artificial Sequence
  Synthetic peptide
  MISC_FEATURE (1)..(1): N-terminal acetylation
  MISC_FEATURE (20)..(20): C-terminal amidation
WPIIVGWELFDTGETTWWKV

SEQ ID NO: 1718 - protein, 20 aa, Artificial Sequence
  Synthetic peptide
  MISC_FEATURE (1)..(1): N-terminal acetylation
  MISC_FEATURE (20)..(20): C-terminal amidation
WKPIVGWELFDTGETTWWKV

SEQ ID NO: 1719 - protein, 20 aa, Artificial Sequence
  Synthetic peptide
  MISC_FEATURE (1)..(1): N-terminal acetylation
  MISC_FEATURE (20)..(20): C-terminal amidation
WKIPVGWELFDTGETTWWKV

SEQ ID NO: 1720 - protein, 20 aa, Artificial Sequence
  Synthetic peptide
  MISC_FEATURE (1)..(1): N-terminal acetylation
  MISC_FEATURE (20)..(20): C-terminal amidation
WKIIPGWELFDTGETTWWKV

SEQ ID NO: 1721 - protein, 20 aa, Artificial Sequence
  Synthetic peptide
  MISC_FEATURE (1)..(1): N-terminal acetylation
  MISC_FEATURE (20)..(20): C-terminal amidation
WKIIVPWELFDTGETTWWKV

SEQ ID NO: 1722 - protein, 20 aa, Artificial Sequence
  Synthetic peptide
  MISC_FEATURE (1)..(1): N-terminal acetylation
  MISC_FEATURE (20)..(20): C-terminal amidation
WKIIVGPELFDTGETTWWKV

SEQ ID NO: 1723 - protein, 20 aa, Artificial Sequence
  Synthetic peptide
  MISC_FEATURE (1)..(1): N-terminal acetylation
  MISC_FEATURE (20)..(20): C-terminal amidation
WKIIVGWPLFDTGETTWWKV

SEQ ID NO: 1724 - protein, 20 aa, Artificial Sequence
  Synthetic peptide
  MISC_FEATURE (1)..(1): N-terminal acetylation
  MISC_FEATURE (20)..(20): C-terminal amidation
WKIIVGWEPFDTGETTWWKV

SEQ ID NO: 1725 - protein, 20 aa, Artificial Sequence
  Synthetic peptide
  MISC_FEATURE (1)..(1): N-terminal acetylation
  MISC_FEATURE (20)..(20): C-terminal amidation
WKIIVGWELPDTGETTWWKV

SEQ ID NO: 1726 - protein, 20 aa, Artificial Sequence
  Synthetic peptide
  MISC_FEATURE (1)..(1): N-terminal acetylation
  MISC_FEATURE (20)..(20): C-terminal amidation
WKIIVGWELFPTGETTWWKV

SEQ ID NO: 1727 - protein, 20 aa, Artificial Sequence
  Synthetic peptide
  MISC_FEATURE (1)..(1): N-terminal acetylation
  MISC_FEATURE (20)..(20): C-terminal amidation
WKIIVGWELFDPGETTWWKV

SEQ ID NO: 1728 - protein, 20 aa, Artificial Sequence
  Synthetic peptide
  MISC_FEATURE (1)..(1): N-terminal acetylation
  MISC_FEATURE (20)..(20): C-terminal amidation
WKIIVGWELFDTPETTWWKV

SEQ ID NO: 1729 - protein, 20 aa, Artificial Sequence
  Synthetic peptide
  MISC_FEATURE (1)..(1): N-terminal acetylation
  MISC_FEATURE (20)..(20): C-terminal amidation
WKIIVGWELFDTGPTTWWKV

SEQ ID NO: 1730 - protein, 20 aa, Artificial Sequence
  Synthetic peptide
  MISC_FEATURE (1)..(1): N-terminal acetylation
  MISC_FEATURE (20)..(20): C-terminal amidation
WKIIVGWELFDTGEPTWWKV

SEQ ID NO: 1731 - protein, 20 aa, Artificial Sequence
  Synthetic peptide
  MISC_FEATURE (1)..(1): N-terminal acetylation
  MISC_FEATURE (20)..(20): C-terminal amidation
WKIIVGWELFDTGETPWWKV

SEQ ID NO: 1732 - protein, 20 aa, Artificial Sequence
  Synthetic peptide
  MISC_FEATURE (1)..(1): N-terminal acetylation
  MISC_FEATURE (20)..(20): C-terminal amidation
WKIIVGWELFDTGETTPWKV

SEQ ID NO: 1733 - protein, 20 aa, Artificial Sequence
  Synthetic peptide
  MISC_FEATURE (1)..(1): N-terminal acetylation
  MISC_FEATURE (20)..(20): C-terminal amidation
WKIIVGWELFDTGETTWPKV

SEQ ID NO: 1734 - protein, 20 aa, Artificial Sequence
  Synthetic peptide
  MISC_FEATURE (1)..(1): N-terminal acetylation
  MISC_FEATURE (20)..(20): C-terminal amidation
WKIIVGWELFDTGETTWWPV

SEQ ID NO: 1735 - protein, 20 aa, Artificial Sequence
  Synthetic peptide
  MISC_FEATURE (1)..(1): N-terminal acetylation
  MISC_FEATURE (20)..(20): C-terminal amidation
WKIIVGWELFDTGETTWWKP

SEQ ID NO: 1736 - protein, 17 aa, Artificial Sequence
  Synthetic peptide
  MISC_FEATURE (1)..(1): N-terminal acetylation
  MISC_FEATURE (17)..(17): C-terminal amidation
WKIIVGWELFDTGETTW

SEQ ID NO: 1737 - protein, 14 aa, Artificial Sequence
  Synthetic peptide
  MISC_FEATURE (1)..(1): N-terminal acetylation
  MISC_FEATURE (14)..(14): C-terminal amidation
WKIIVGWELFDTGE

SEQ ID NO: 1738 - protein, 11 aa, Artificial Sequence
  Synthetic peptide
  MISC_FEATURE (1)..(1): N-terminal acetylation
  MISC_FEATURE (11)..(11): C-terminal amidation
WKIIVGWELFD

SEQ ID NO: 1739 - protein, 8 aa, Artificial Sequence
  Synthetic peptide
  MISC_FEATURE (1)..(1): N-terminal acetylation
  MISC_FEATURE (8)..(8): C-terminal amidation
WKIIVGWE

SEQ ID NO: 1740 - protein, 17 aa, Artificial Sequence
  Synthetic peptide
  MISC_FEATURE (1)..(1): N-terminal acetylation
  MISC_FEATURE (17)..(17): C-terminal amidation
IVGWELFDTGETTWWKV

SEQ ID NO: 1741 - protein, 14 aa, Artificial Sequence
  Synthetic peptide
  MISC_FEATURE (1)..(1): N-terminal acetylation
  MISC_FEATURE (14)..(14): C-terminal amidation
WELFDTGETTWWKV

SEQ ID NO: 1742 - protein, 11 aa, Artificial Sequence
  Synthetic peptide
  MISC_FEATURE (1)..(1): N-terminal acetylation
  MISC_FEATURE (11)..(11): C-terminal amidation
FDTGETTWWKV

SEQ ID NO: 1743 - protein, 8 aa, Artificial Sequence
  Synthetic peptide
  MISC_FEATURE (1)..(1): N-terminal acetylation
  MISC_FEATURE (8)..(8): C-terminal amidation
GETTWWKV

SEQ ID NO: 1744 - protein, 14 aa, Artificial Sequence
  Synthetic peptide
  MISC_FEATURE (1)..(1): N-terminal acetylation
  MISC_FEATURE (14)..(14): C-terminal amidation
IVGWELFDTGETTW

SEQ ID NO: 1745 - protein, 8 aa, Artificial Sequence
  Synthetic peptide
  MISC_FEATURE (1)..(1): N-terminal acetylation
  MISC_FEATURE (8)..(8): C-terminal amidation
WELFDTGE

SEQ ID NO: 1746 - protein, 20 aa, Artificial Sequence
  Synthetic peptide
  MISC_FEATURE (1)..(1): N-terminal acetylation
  MISC_FEATURE (20)..(20): C-terminal amidation
DFGNENKWGSVWAVSFAFWY

SEQ ID NO: 1747 - protein, 20 aa, Artificial Sequence
  Synthetic peptide
  MISC_FEATURE (1)..(1): N-terminal acetylation
  MISC_FEATURE (20)..(20): C-terminal amidation
VFANGKSGWWFYNFEWDVAS

SEQ ID NO: 1748 - protein, 20 aa, Artificial Sequence
  Synthetic peptide
  MISC_FEATURE (1)..(1): N-terminal acetylation
  MISC_FEATURE (20)..(20): C-terminal amidation
WLELYSVVFRPPEQGWHVWW

SEQ ID NO: 1749 - protein, 20 aa, Artificial Sequence
  Synthetic peptide
  MISC_FEATURE (1)..(1): N-terminal acetylation
  MISC_FEATURE (20)..(20): C-terminal amidation
WHQSEYPVVFGLWPREWWLV

SEQ ID NO: 1750 - protein, 20 aa, Artificial Sequence
  Synthetic peptide
  MISC_FEATURE (1)..(1): N-terminal acetylation
  MISC_FEATURE (20)..(20): C-terminal amidation
GGLITTWNIEWELRRIIAPS

SEQ ID NO: 1751 - protein, 20 aa, Artificial Sequence
  Synthetic peptide
  MISC_FEATURE (1)..(1): N-terminal acetylation
  MISC_FEATURE (20)..(20): C-terminal amidation
PATGLIIWSETRGIRLIWNE

SEQ ID NO: 1752 - protein, 20 aa, Artificial Sequence
  Synthetic peptide
  MISC_FEATURE (1)..(1): N-terminal acetylation
  MISC_FEATURE (20)..(20): C-terminal amidation
TSGSAWGWEIPVVEYGIVYL

SEQ ID NO: 1753 - protein, 20 aa, Artificial Sequence
  Synthetic peptide
  MISC_FEATURE (1)..(1): N-terminal acetylation
  MISC_FEATURE (20)..(20): C-terminal amidation
VAYVWTLYVGISEESPGIGW

SEQ ID NO: 1754 - protein, 20 aa, Artificial Sequence
  Synthetic peptide
  MISC_FEATURE (1)..(1): N-terminal acetylation
  MISC_FEATURE (20)..(20): C-terminal amidation
TGIVLGWWTDIKTEFEVWWK

SEQ ID NO: 1755 - protein, 20 aa, Artificial Sequence
  Synthetic peptide
  MISC_FEATURE (1)..(1): N-terminal acetylation
  MISC_FEATURE (20)..(20): C-terminal amidation
KWLWTKGWVDTFVIEITGWE

SEQ ID NO: 1756 - protein, 20 aa, Artificial Sequence
  Synthetic peptide
  MISC_FEATURE (1)..(1): N-terminal acetylation
  MISC_FEATURE (20)..(20): C-terminal amidation
LDGISLGGPVIWVNIEDIER

SEQ ID NO: 1757 - protein, 20 aa, Artificial Sequence
  Synthetic peptide
  MISC_FEATURE (1)..(1): N-terminal acetylation
  MISC_FEATURE (20)..(20): C-terminal amidation
GLVIIEPDLIVDSGGWENRI

SEQ ID NO: 1758 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XGQIEWGFYDHTTNQYWSMDV

SEQ ID NO: 1759 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XLHELGRIQTEQYSIEIYYVH

SEQ ID NO: 1760 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XHRIEIWWYNSGTNKHGLVHT

SEQ ID NO: 1761 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XGRHTNDINKMRRAVQALFEN

SEQ ID NO: 1762 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XWGLGFYDVNTWRHTPIAFKT

SEQ ID NO: 1763 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XVWISLGWYDMVNDRHSSLIM

SEQ ID NO: 1764 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XRKEYEWAEREGWKTTLSMFL

SEQ ID NO: 1765 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XAYMWMIGMYYTELDTHKVVA

SEQ ID NO: 1766 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XTVNSSVDWGYEMYASQWRHN

SEQ ID NO: 1767 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XHVHLTYQIEVGWEYVKEIYK

SEQ ID NO: 1768 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XRLRIELGVIVDGQVLIWKVL

SEQ ID NO: 1769 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XHGVEVGFWDTVMDKVYIVHM

SEQ ID NO: 1770 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XIWVGYFNYEDNYWSQIGSMT

SEQ ID NO: 1771 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XSHRWRRLRELKWYVEFGWEV

SEQ ID NO: 1772 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XYEWVDRAGEMALFTLRDFYA

SEQ ID NO: 1773 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XIFTVELWWDSTQGEGMIWSI

SEQ ID NO: 1774 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XWVSLGWYDSRSVNEQWYSVW

SEQ ID NO: 1775 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XLWVFRRHSDKNGIYEVGYEV

SEQ ID NO: 1776 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XGVTAGHYYIDINTYKPFESG

SEQ ID NO: 1777 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XWLVVRVNNQISVWWDVGFTT

SEQ ID NO: 1778 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XEDPWEWQVWISVNGTEIRLH

SEQ ID NO: 1779 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XWRFWHAHENSGFLVEIGYER

SEQ ID NO: 1780 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XEKTIEVGLYFKKEDVYKPMG

SEQ ID NO: 1781 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XKLIRVGFYNLNTNTHTYWED

SEQ ID NO: 1782 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XSIVIMGFYNYNSDTYKLWSM

SEQ ID NO: 1783 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XLAIEMWWQSVAETEHKGLIW

SEQ ID NO: 1784 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XAVWPERRVTVVYYRWHVPAK

SEQ ID NO: 1785 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XGNRNLDWLHTYSVELFWELN

SEQ ID NO: 1786 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XGITVGYMNMDSGAYLIIWSR

SEQ ID NO: 1787 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XTWNSRVYLGMNYEVEIGYEQ

SEQ ID NO: 1788 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XEVFLLMLWYDAKGNEVRMRI

SEQ ID NO: 1789 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XHVQIGWYSVDSDRHYAYSSY

SEQ ID NO: 1790 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XSIVVGWYWRATDRHIRFHRS

SEQ ID NO: 1791 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XWVVATGSNWELWVEPWNGKA

SEQ ID NO: 1792 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XVVWRSANRMIVFGWEYHDNY

SEQ ID NO: 1793 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XYTVEVGWHTVHTGRDNYVWM

SEQ ID NO: 1794 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XYVEVGYYFHTTGNEVIIYAN

SEQ ID NO: 1795 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XSIVIMGFYNYNSDTYKLWGM

SEQ ID NO: 1796 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XYTVEVGWHTVHAGRDNYMWV

SEQ ID NO: 1797 - protein, 20 aa, Artificial Sequence
  Synthetic peptide
  MISC_FEATURE (1)..(1): N-terminal biotinyl
  MISC_FEATURE (20)..(20): C-terminal amidation
YTVEVGWHTVHTGKDNSMWM

SEQ ID NO: 1798 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XTWVEIGFYDRINDRIWRLYS

SEQ ID NO: 1799 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XYRTNRAIVTVGWAIASTYTH

SEQ ID NO: 1800 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XYAVEVGWHTVHTGRDNYMWM

SEQ ID NO: 1801 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XYTVEVGWHTVHTGRDNYMWV

SEQ ID NO: 1802 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XYVEVGYYFHTTDNEVVIYAN

SEQ ID NO: 1803 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XYTVEVGWHTAHTGRDNYMWM

SEQ ID NO: 1804 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XYVEVGYYFHATDNEVIIYAN

SEQ ID NO: 1805 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XYIVEVGWHTVHTGRDNYMWM

SEQ ID NO: 1806 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XRIELGWHVLEDGRDHGIRWI

SEQ ID NO: 1807 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XQVWVGYYNTIENTELVMWTV

SEQ ID NO: 1808 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XYVEVGYYSHTTDNEVIIYAN

SEQ ID NO: 1809 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XSIEVGTYDSRTEKYRIWFYY

SEQ ID NO: 1810 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XWSIELYIENLDDGEEVMVWT

SEQ ID NO: 1811 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XYTVEVGWHTVYTGRDNYMWM

SEQ ID NO: 1812 - protein, 20 aa, Artificial Sequence
  Synthetic peptide
  MISC_FEATURE (1)..(1): N-terminal acetylation
  DISULFID (6)..(16): Cys residues linked via disulfide bond
  MISC_FEATURE (20)..(20): C-terminal amidation
TENAVCIRITMWIELCSERI

SEQ ID NO: 1813 - protein, 20 aa, Artificial Sequence
  Synthetic peptide
  MISC_FEATURE (1)..(1): N-terminal acetylation
  MISC_FEATURE (20)..(20): C-terminal amidation
VYEVGWDHGNWYEIIWRYPS

SEQ ID NO: 1814 - protein, 20 aa, Artificial Sequence
  Synthetic peptide
  MISC_FEATURE (1)..(1): N-terminal acetylation
  MISC_FEATURE (20)..(20): C-terminal amidation
GVIHYEWWNDYEVSYPRIWG

SEQ ID NO: 1815 - protein, 20 aa, Artificial Sequence
  Synthetic peptide
  MISC_FEATURE (1)..(1): N-terminal acetylation
  MISC_FEATURE (20)..(20): C-terminal amidation
RIIWYWGWGSVYVEEYDNHP

SEQ ID NO: 1816 - protein, 20 aa, Artificial Sequence
  Synthetic peptide
  MISC_FEATURE (1)..(1): N-terminal acetylation
  MISC_FEATURE (20)..(20): C-terminal amidation
YTVEVGWHTVHTGRDNYMWM

SEQ ID NO: 1817 - protein, 20 aa, Artificial Sequence
  Synthetic peptide
  MISC_FEATURE (1)..(1): N-terminal acetylation
  MISC_FEATURE (20)..(20): C-terminal amidation
GWTTMYHVVHMVEGYWDTNR

SEQ ID NO: 1818 - protein, 20 aa, Artificial Sequence
  Synthetic peptide
  MISC_FEATURE (1)..(1): N-terminal acetylation
  MISC_FEATURE (20)..(20): C-terminal amidation
REHMVNVGWDWTYGTTYVHM

SEQ ID NO: 1819 - protein, 20 aa, Artificial Sequence
  Synthetic peptide
  MISC_FEATURE (1)..(1): N-terminal acetylation
  MISC_FEATURE (20)..(20): C-terminal amidation
GRHTNDINKMRRAVQALFEN

SEQ ID NO: 1820 - protein, 20 aa, Artificial Sequence
  Synthetic peptide
  MISC_FEATURE (1)..(1): N-terminal acetylation
  MISC_FEATURE (20)..(20): C-terminal amidation
FAENDVNMHNIGRLRQTARK

SEQ ID NO: 1821 - protein, 20 aa, Artificial Sequence
  Synthetic peptide
  MISC_FEATURE (1)..(1): N-terminal acetylation
  MISC_FEATURE (20)..(20): C-terminal amidation
QRTKAMRNRLFEHGINDAVN

SEQ ID NO: 1822 - protein, 20 aa, Artificial Sequence
  Synthetic peptide
  MISC_FEATURE (1)..(1): N-terminal acetylation
  MISC_FEATURE (20)..(20): C-terminal amidation
HVQIGWYSVDSDRHYAYSSY

SEQ ID NO: 1823 - protein, 20 aa, Artificial Sequence
  Synthetic peptide
  MISC_FEATURE (1)..(1): N-terminal acetylation
  MISC_FEATURE (20)..(20): C-terminal amidation
YQGSHDWHYSSDYVSRYAVI

SEQ ID NO: 1824 - protein, 20 aa, Artificial Sequence
  Synthetic peptide
  MISC_FEATURE (1)..(1): N-terminal acetylation
  MISC_FEATURE (20)..(20): C-terminal amidation
YHSYDGYWSIHAYDRVQSSV

SEQ ID NO: 1825 - protein, 20 aa, Artificial Sequence
  Synthetic peptide
  MISC_FEATURE (1)..(1): N-terminal acetylation
  MISC_FEATURE (20)..(20): C-terminal amidation
YVEVGYYFHTTDNEVVIYAN

SEQ ID NO: 1826 - protein, 20 aa, Artificial Sequence
  Synthetic peptide
  MISC_FEATURE (1)..(1): N-terminal acetylation
  MISC_FEATURE (20)..(20): C-terminal amidation
FGNYVNYEVADETVVTIHYY

SEQ ID NO: 1827 - protein, 20 aa, Artificial Sequence
  Synthetic peptide
  MISC_FEATURE (1)..(1): N-terminal acetylation
  MISC_FEATURE (20)..(20): C-terminal amidation
YAEYTFVEHVVNTGDYINVY

SEQ ID NO: 1828 - protein, 20 aa, Artificial Sequence
  Synthetic peptide
  MISC_FEATURE (1)..(1): N-terminal acetylation
  MISC_FEATURE (20)..(20): C-terminal amidation
SIEVGTYDSRTEKYRIWFYY

SEQ ID NO: 1829 - protein, 20 aa, Artificial Sequence
  Synthetic peptide
  MISC_FEATURE (1)..(1): N-terminal acetylation
  MISC_FEATURE (20)..(20): C-terminal amidation
YIKWYERTSDTVFGRISYYE

SEQ ID NO: 1830 - protein, 20 aa, Artificial Sequence
  Synthetic peptide
  MISC_FEATURE (1)..(1): N-terminal acetylation
  MISC_FEATURE (20)..(20): C-terminal amidation
FEYTIYKYRWTRGSDYVISE

SEQ ID NO: 1831 - protein, 20 aa, Artificial Sequence
  Synthetic peptide
  MISC_FEATURE (1)..(1): N-terminal acetylation
  DISULFID (7)..(17): Cys residues linked via disulfide bond
  MISC_FEATURE (20)..(20): C-terminal amidation
VFQKEECVLATESVWVCWGN

SEQ ID NO: 1832 - protein, 20 aa, Artificial Sequence
  Synthetic peptide
  MISC_FEATURE (1)..(1): N-terminal acetylation
  DISULFID (7)..(17): Cys residues linked via disulfide bond
  MISC_FEATURE (20)..(20): C-terminal amidation
QGWVNSCETLFAVVEKCEWV

SEQ ID NO: 1833 - protein, 20 aa, Artificial Sequence
  Synthetic peptide
  MISC_FEATURE (1)..(1): N-terminal acetylation
  DISULFID (7)..(17): Cys residues linked via disulfide bond
  MISC_FEATURE (20)..(20): C-terminal amidation
EVWKWNCTSVFEVGQVCAEL

SEQ ID NO: 1834 - protein, 20 aa, Artificial Sequence
  Synthetic peptide
  MISC_FEATURE (1)..(1): N-terminal acetylation
  MISC_FEATURE (20)..(20): C-terminal amidation
DQVWWWGPKARMGLIEYGWE

SEQ ID NO: 1835 - protein, 20 aa, Artificial Sequence
  Synthetic peptide
  MISC_FEATURE (1)..(1): N-terminal acetylation
  MISC_FEATURE (20)..(20): C-terminal amidation
AGWVIDQLYWKGMPWGWERE

SEQ ID NO: 1836 - protein, 20 aa, Artificial Sequence
  Synthetic peptide
  MISC_FEATURE (1)..(1): N-terminal acetylation
  MISC_FEATURE (20)..(20): C-terminal amidation
RIDGEYLQMWAWPWEWKVGG

SEQ ID NO: 1837 - protein, 20 aa, Artificial Sequence
  Synthetic peptide
  MISC_FEATURE (1)..(1): N-terminal acetylation
  DISULFID (8)..(18): Cys residues linked via disulfide bond
  MISC_FEATURE (20)..(20): C-terminal amidation
EREDTTYCVVVASGVELCWQ

SEQ ID NO: 1838 - protein, 20 aa, Artificial Sequence
  Synthetic peptide
  MISC_FEATURE (1)..(1): N-terminal acetylation
  DISULFID (8)..(18): Cys residues linked via disulfide bond
  MISC_FEATURE (20)..(20): C-terminal amidation
TSVGTVECYEWVLDQAECVR

SEQ ID NO: 1839 - protein, 20 aa, Artificial Sequence
  Synthetic peptide
  MISC_FEATURE (1)..(1): N-terminal acetylation
  DISULFID (8)..(18): Cys residues linked via disulfide bond
  MISC_FEATURE (20)..(20): C-terminal amidation
ETQTSEYCGWVAERDVVCLV

SEQ ID NO: 1840 - protein, 20 aa, Artificial Sequence
  Synthetic peptide
  MISC_FEATURE (1)..(1): N-terminal acetylation
  DISULFID (7)..(17): Cys residues linked via disulfide bond
  MISC_FEATURE (20)..(20): C-terminal amidation
LDGGHWCWEISDSVMLCVAV

SEQ ID NO: 1841 - protein, 20 aa, Artificial Sequence
  Synthetic peptide
  MISC_FEATURE (1)..(1): N-terminal acetylation
  DISULFID (7)..(17): Cys residues linked via disulfide bond
  MISC_FEATURE (20)..(20): C-terminal amidation
LHVWSDCIWLDVGESMCVGA

SEQ ID NO: 1842 - protein, 20 aa, Artificial Sequence
  Synthetic peptide
  MISC_FEATURE (1)..(1): N-terminal acetylation
  DISULFID (7)..(17): Cys residues linked via disulfide bond
  MISC_FEATURE (20)..(20): C-terminal amidation
VWLMVLCIDGVSDGWHCASE

SEQ ID NO: 1843 - protein, 20 aa, Artificial Sequence
  Synthetic peptide
  MISC_FEATURE (1)..(1): N-terminal acetylation
  MISC_FEATURE (20)..(20): C-terminal amidation
IEVGWYNVVTQKHSKLGMLI

SEQ ID NO: 1844 - protein, 20 aa, Artificial Sequence
  Synthetic peptide
  MISC_FEATURE (1)..(1): N-terminal acetylation
  MISC_FEATURE (20)..(20): C-terminal amidation
KGQVEIGLYWVKLHVISMTN

SEQ ID NO: 1845 - protein, 20 aa, Artificial Sequence
  Synthetic peptide
  MISC_FEATURE (1)..(1): N-terminal acetylation
  MISC_FEATURE (20)..(20): C-terminal amidation
QIVIVLETGHWKSNMYKGLV

SEQ ID NO: 1846 - protein, 20 aa, Artificial Sequence
  Synthetic peptide
  MISC_FEATURE (1)..(1): N-terminal acetylation
  MISC_FEATURE (20)..(20): C-terminal amidation
VEVGWEQDGVTVWTVTWYHT

SEQ ID NO: 1847 - protein, 20 aa, Artificial Sequence
  Synthetic peptide
  MISC_FEATURE (1)..(1): N-terminal acetylation
  MISC_FEATURE (20)..(20): C-terminal amidation
EHVTVDVEWVVTGWQYWTGT

SEQ ID NO: 1848 - protein, 20 aa, Artificial Sequence
  Synthetic peptide
  MISC_FEATURE (1)..(1): N-terminal acetylation
  MISC_FEATURE (20)..(20): C-terminal amidation
QWVWTHDTVEVEYVGGTWVT

SEQ ID NO: 1849 - protein, 20 aa, Artificial Sequence
  Synthetic peptide
  MISC_FEATURE (1)..(1): N-terminal acetylation
  MISC_FEATURE (20)..(20): C-terminal amidation
AYEVGWDHGNWYEIIWRYPS

SEQ ID NO: 1850 - protein, 20 aa, Artificial Sequence
  Synthetic peptide
  MISC_FEATURE (1)..(1): N-terminal acetylation
  MISC_FEATURE (20)..(20): C-terminal amidation
VAEVGWDHGNWYEIIWRYPS

SEQ ID NO: 1851 - protein, 20 aa, Artificial Sequence
  Synthetic peptide
  MISC_FEATURE (1)..(1): N-terminal acetylation
  MISC_FEATURE (20)..(20): C-terminal amidation
VYAVGWDHGNWYEIIWRYPS

SEQ ID NO: 1852 - protein, 20 aa, Artificial Sequence
  Synthetic peptide
  MISC_FEATURE (1)..(1): N-terminal acetylation
  MISC_FEATURE (20)..(20): C-terminal amidation
VYEAGWDHGNWYEIIWRYPS

SEQ ID NO: 1853 - protein, 20 aa, Artificial Sequence
  Synthetic peptide
  MISC_FEATURE (1)..(1): N-terminal acetylation
  MISC_FEATURE (20)..(20): C-terminal amidation
VYEVAWDHGNWYEIIWRYPS

SEQ ID NO: 1854 - protein, 20 aa, Artificial Sequence
  Synthetic peptide
  MISC_FEATURE (1)..(1): N-terminal acetylation
  MISC_FEATURE (20)..(20): C-terminal amidation
VYEVGADHGNWYEIIWRYPS

SEQ ID NO: 1855 - protein, 20 aa, Artificial Sequence
  Synthetic peptide
  MISC_FEATURE (1)..(1): N-terminal acetylation
  MISC_FEATURE (20)..(20): C-terminal amidation
VYEVGWAHGNWYEIIWRYPS

SEQ ID NO: 1856 - protein, 20 aa, Artificial Sequence
  Synthetic peptide
  MISC_FEATURE (1)..(1): N-terminal acetylation
  MISC_FEATURE (20)..(20): C-terminal amidation
VYEVGWDAGNWYEIIWRYPS

SEQ ID NO: 1857 - protein, 20 aa, Artificial Sequence
  Synthetic peptide
  MISC_FEATURE (1)..(1): N-terminal acetylation
  MISC_FEATURE (20)..(20): C-terminal amidation
VYEVGWDHANWYEIIWRYPS

SEQ ID NO: 1858 - protein, 20 aa, Artificial Sequence
  Synthetic peptide
  MISC_FEATURE (1)..(1): N-terminal acetylation
  MISC_FEATURE (20)..(20): C-terminal amidation
VYEVGWDHGAWYEIIWRYPS

SEQ ID NO: 1859 - protein, 20 aa, Artificial Sequence
  Synthetic peptide
  MISC_FEATURE (1)..(1): N-terminal acetylation
  MISC_FEATURE (20)..(20): C-terminal amidation
VYEVGWDHGNAYEIIWRYPS

SEQ ID NO: 1860 - protein, 20 aa, Artificial Sequence
  Synthetic peptide
  MISC_FEATURE (1)..(1): N-terminal acetylation
  MISC_FEATURE (20)..(20): C-terminal amidation
VYEVGWDHGNWAEIIWRYPS

SEQ ID NO: 1861 - protein, 20 aa, Artificial Sequence
  Synthetic peptide
  MISC_FEATURE (1)..(1): N-terminal acetylation
  MISC_FEATURE (20)..(20): C-terminal amidation
VYEVGWDHGNWYAIIWRYPS

SEQ ID NO: 1862 - protein, 20 aa, Artificial Sequence
  Synthetic peptide
  MISC_FEATURE (1)..(1): N-terminal acetylation
  MISC_FEATURE (20)..(20): C-terminal amidation
VYEVGWDHGNWYEAIWRYPS

SEQ ID NO: 1863 - protein, 20 aa, Artificial Sequence
  Synthetic peptide
  MISC_FEATURE (1)..(1): N-terminal acetylation
  MISC_FEATURE (20)..(20): C-terminal amidation
VYEVGWDHGNWYEIAWRYPS

SEQ ID NO: 1864 - protein, 20 aa, Artificial Sequence
  Synthetic peptide
  MISC_FEATURE (1)..(1): N-terminal acetylation
  MISC_FEATURE (20)..(20): C-terminal amidation
VYEVGWDHGNWYEIIARYPS

SEQ ID NO: 1865 - protein, 20 aa, Artificial Sequence
  Synthetic peptide
  MISC_FEATURE (1)..(1): N-terminal acetylation
  MISC_FEATURE (20)..(20): C-terminal amidation
VYEVGWDHGNWYEIIWAYPS

SEQ ID NO: 1866 - protein, 20 aa, Artificial Sequence
  Synthetic peptide
  MISC_FEATURE (1)..(1): N-terminal acetylation
  MISC_FEATURE (20)..(20): C-terminal amidation
VYEVGWDHGNWYEIIWRAPS

SEQ ID NO: 1867 - protein, 20 aa, Artificial Sequence
  Synthetic peptide
  MISC_FEATURE (1)..(1): N-terminal acetylation
  MISC_FEATURE (20)..(20): C-terminal amidation
VYEVGWDHGNWYEIIWRYAS

SEQ ID NO: 1868 - protein, 20 aa, Artificial Sequence
  Synthetic peptide
  MISC_FEATURE (1)..(1): N-terminal acetylation
  MISC_FEATURE (20)..(20): C-terminal amidation
VYEVGWDHGNWYEIIWRYPA

SEQ ID NO: 1869 - protein, 20 aa, Artificial Sequence
  Synthetic peptide
  MISC_FEATURE (1)..(1): N-terminal acetylation
  MISC_FEATURE (20)..(20): C-terminal amidation
DYEVGWDHGNWYEIIWRYPS

SEQ ID NO: 1870 - protein, 20 aa, Artificial Sequence
  Synthetic peptide
  MISC_FEATURE (1)..(1): N-terminal acetylation
  MISC_FEATURE (20)..(20): C-terminal amidation
VDEVGWDHGNWYEIIWRYPS

SEQ ID NO: 1871 - protein, 20 aa, Artificial Sequence
  Synthetic peptide
  MISC_FEATURE (1)..(1): N-terminal acetylation
  MISC_FEATURE (20)..(20): C-terminal amidation
VYDVGWDHGNWYEIIWRYPS

SEQ ID NO: 1872 - protein, 20 aa, Artificial Sequence
  Synthetic peptide
  MISC_FEATURE (1)..(1): N-terminal acetylation
  MISC_FEATURE (20)..(20): C-terminal amidation
VYEDGWDHGNWYEIIWRYPS

SEQ ID NO: 1873 - protein, 20 aa, Artificial Sequence
  Synthetic peptide
  MISC_FEATURE (1)..(1): N-terminal acetylation
  MISC_FEATURE (20)..(20): C-terminal amidation
VYEVDWDHGNWYEIIWRYPS

SEQ ID NO: 1874 - protein, 20 aa, Artificial Sequence
  Synthetic peptide
  MISC_FEATURE (1)..(1): N-terminal acetylation
  MISC_FEATURE (20)..(20): C-terminal amidation
VYEVGDDHGNWYEIIWRYPS

SEQ ID NO: 1875 - protein, 20 aa, Artificial Sequence
  Synthetic peptide
  MISC_FEATURE (1)..(1): N-terminal acetylation
  MISC_FEATURE (20)..(20): C-terminal amidation
VYEVGWDDGNWYEIIWRYPS

SEQ ID NO: 1876 - protein, 20 aa, Artificial Sequence
  Synthetic peptide
  MISC_FEATURE (1)..(1): N-terminal acetylation
  MISC_FEATURE (20)..(20): C-terminal amidation
VYEVGWDHDNWYEIIWRYPS

SEQ ID NO: 1877 - protein, 20 aa, Artificial Sequence
  Synthetic peptide
  MISC_FEATURE (1)..(1): N-terminal acetylation
  MISC_FEATURE (20)..(20): C-terminal amidation
VYEVGWDHGDWYEIIWRYPS

SEQ ID NO: 1878 - protein, 20 aa, Artificial Sequence
  Synthetic peptide
  MISC_FEATURE (1)..(1): N-terminal acetylation
  MISC_FEATURE (20)..(20): C-terminal amidation
VYEVGWDHGNDYEIIWRYPS

SEQ ID NO: 1879 - protein, 20 aa, Artificial Sequence
  Synthetic peptide
  MISC_FEATURE (1)..(1): N-terminal acetylation
  MISC_FEATURE (20)..(20): C-terminal amidation
VYEVGWDHGNWDEIIWRYPS

SEQ ID NO: 1880 - protein, 20 aa, Artificial Sequence
  Synthetic peptide
  MISC_FEATURE (1)..(1): N-terminal acetylation
  MISC_FEATURE (20)..(20): C-terminal amidation
VYEVGWDHGNWYDIIWRYPS

SEQ ID NO: 1881 - protein, 20 aa, Artificial Sequence
  Synthetic peptide
  MISC_FEATURE (1)..(1): N-terminal acetylation
  MISC_FEATURE (20)..(20): C-terminal amidation
VYEVGWDHGNWYEDIWRYPS

SEQ ID NO: 1882 - protein, 20 aa, Artificial Sequence
  Synthetic peptide
  MISC_FEATURE (1)..(1): N-terminal acetylation
  MISC_FEATURE (20)..(20): C-terminal amidation
VYEVGWDHGNWYEIDWRYPS

SEQ ID NO: 1883 - protein, 20 aa, Artificial Sequence
  Synthetic peptide
  MISC_FEATURE (1)..(1): N-terminal acetylation
  MISC_FEATURE (20)..(20): C-terminal amidation
VYEVGWDHGNWYEIIDRYPS

SEQ ID NO: 1884 - protein, 20 aa, Artificial Sequence
  Synthetic peptide
  MISC_FEATURE (1)..(1): N-terminal acetylation
  MISC_FEATURE (20)..(20): C-terminal amidation
VYEVGWDHGNWYEIIWDYPS

SEQ ID NO: 1885 - protein, 20 aa, Artificial Sequence
  Synthetic peptide
  MISC_FEATURE (1)..(1): N-terminal acetylation
  MISC_FEATURE (20)..(20): C-terminal amidation
VYEVGWDHGNWYEIIWRDPS

SEQ ID NO: 1886 - protein, 20 aa, Artificial Sequence
  Synthetic peptide
  MISC_FEATURE (1)..(1): N-terminal acetylation
  MISC_FEATURE (20)..(20): C-terminal amidation
VYEVGWDHGNWYEIIWRYDS

SEQ ID NO: 1887 - protein, 20 aa, Artificial Sequence
  Synthetic peptide
  MISC_FEATURE (1)..(1): N-terminal acetylation
  MISC_FEATURE (20)..(20): C-terminal amidation
VYEVGWDHGNWYEIIWRYPD

SEQ ID NO: 1888 - protein, 20 aa, Artificial Sequence
  Synthetic peptide
  MISC_FEATURE (1)..(1): N-terminal acetylation
  MISC_FEATURE (20)..(20): C-terminal amidation
GYEVGWDHGNWYEIIWRYPS

SEQ ID NO: 1889 - protein, 20 aa, Artificial Sequence
  Synthetic peptide
  MISC_FEATURE (1)..(1): N-terminal acetylation
  MISC_FEATURE (20)..(20): C-terminal amidation
VGEVGWDHGNWYEIIWRYPS

SEQ ID NO: 1890 - protein, 20 aa, Artificial Sequence
  Synthetic peptide
  MISC_FEATURE (1)..(1): N-terminal acetylation
  MISC_FEATURE (20)..(20): C-terminal amidation
VYGVGWDHGNWYEIIWRYPS

SEQ ID NO: 1891 - protein, 20 aa, Artificial Sequence
  Synthetic peptide
  MISC_FEATURE (1)..(1): N-terminal acetylation
  MISC_FEATURE (20)..(20): C-terminal amidation
VYEGGWDHGNWYEIIWRYPS

SEQ ID NO: 1892 - protein, 20 aa, Artificial Sequence
  Synthetic peptide
  MISC_FEATURE (1)..(1): N-terminal acetylation
  MISC_FEATURE (20)..(20): C-terminal amidation
VYEVGGDHGNWYEIIWRYPS

SEQ ID NO: 1893 - protein, 20 aa, Artificial Sequence
  Synthetic peptide
  MISC_FEATURE (1)..(1): N-terminal acetylation
  MISC_FEATURE (20)..(20): C-terminal amidation
VYEVGWGHGNWYEIIWRYPS

SEQ ID NO: 1894 - protein, 20 aa, Artificial Sequence
  Synthetic peptide
  MISC_FEATURE (1)..(1): N-terminal acetylation
  MISC_FEATURE (20)..(20): C-terminal amidation
VYEVGWDGGNWYEIIWRYPS

SEQ ID NO: 1895 - protein, 20 aa, Artificial Sequence
  Synthetic peptide
  MISC_FEATURE (1)..(1): N-terminal acetylation
  MISC_FEATURE (20)..(20): C-terminal amidation
VYEVGWDHGGWYEIIWRYPS

SEQ ID NO: 1896 - protein, 20 aa, Artificial Sequence
  Synthetic peptide
  MISC_FEATURE (1)..(1): N-terminal acetylation
  MISC_FEATURE (20)..(20): C-terminal amidation
VYEVGWDHGNGYEIIWRYPS

SEQ ID NO: 1897 - protein, 20 aa, Artificial Sequence
  Synthetic peptide
  MISC_FEATURE (1)..(1): N-terminal acetylation
  MISC_FEATURE (20)..(20): C-terminal amidation
VYEVGWDHGNWGEIIWRYPS

SEQ ID NO: 1898 - protein, 20 aa, Artificial Sequence
  Synthetic peptide
  MISC_FEATURE (1)..(1): N-terminal acetylation
  MISC_FEATURE (20)..(20): C-terminal amidation
VYEVGWDHGNWYGIIWRYPS

SEQ ID NO: 1899 - protein, 20 aa, Artificial Sequence
  Synthetic peptide
  MISC_FEATURE (1)..(1): N-terminal acetylation
  MISC_FEATURE (20)..(20): C-terminal amidation
VYEVGWDHGNWYEGIWRYPS

SEQ ID NO: 1900 - protein, 20 aa, Artificial Sequence
  Synthetic peptide
  MISC_FEATURE (1)..(1): N-terminal acetylation
  MISC_FEATURE (20)..(20): C-terminal amidation
VYEVGWDHGNWYEIGWRYPS

SEQ ID NO: 1901 - protein, 20 aa, Artificial Sequence
  Synthetic peptide
  MISC_FEATURE (1)..(1): N-terminal acetylation
  MISC_FEATURE (20)..(20): C-terminal amidation
VYEVGWDHGNWYEIIGRYPS

SEQ ID NO: 1902 - protein, 20 aa, Artificial Sequence
  Synthetic peptide
  MISC_FEATURE (1)..(1): N-terminal acetylation
  MISC_FEATURE (20)..(20): C-terminal amidation
VYEVGWDHGNWYEIIWGYPS

SEQ ID NO: 1903 - protein, 20 aa, Artificial Sequence
  Synthetic peptide
  MISC_FEATURE (1)..(1): N-terminal acetylation
  MISC_FEATURE (20)..(20): C-terminal amidation
VYEVGWDHGNWYEIIWRGPS

SEQ ID NO: 1904 - protein, 20 aa, Artificial Sequence
  Synthetic peptide
  MISC_FEATURE (1)..(1): N-terminal acetylation
  MISC_FEATURE (20)..(20): C-terminal amidation
VYEVGWDHGNWYEIIWRYGS

SEQ ID NO: 1905 - protein, 20 aa, Artificial Sequence
  Synthetic peptide
  MISC_FEATURE (1)..(1): N-terminal acetylation
  MISC_FEATURE (20)..(20): C-terminal amidation
VYEVGWDHGNWYEIIWRYPG

SEQ ID NO: 1906 - protein, 20 aa, Artificial Sequence
  Synthetic peptide
  MISC_FEATURE (1)..(1): N-terminal acetylation
  MISC_FEATURE (20)..(20): C-terminal amidation
LYEVGWDHGNWYEIIWRYPS

SEQ ID NO: 1907 - protein, 20 aa, Artificial Sequence
  Synthetic peptide
  MISC_FEATURE (1)..(1): N-terminal acetylation
  MISC_FEATURE (20)..(20): C-terminal amidation
VLEVGWDHGNWYEIIWRYPS

SEQ ID NO: 1908 - protein, 20 aa, Artificial Sequence
  Synthetic peptide
  MISC_FEATURE (1)..(1): N-terminal acetylation
  MISC_FEATURE (20)..(20): C-terminal amidation
VYLVGWDHGNWYEIIWRYPS

SEQ ID NO: 1909 - protein, 20 aa, Artificial Sequence
  Synthetic peptide
  MISC_FEATURE (1)..(1): N-terminal acetylation
  MISC_FEATURE (20)..(20): C-terminal amidation
VYELGWDHGNWYEIIWRYPS

SEQ ID NO: 1910 - protein, 20 aa, Artificial Sequence
  Synthetic peptide
  MISC_FEATURE (1)..(1): N-terminal acetylation
  MISC_FEATURE (20)..(20): C-terminal amidation
VYEVLWDHGNWYEIIWRYPS

SEQ ID NO: 1911 - protein, 20 aa, Artificial Sequence
  Synthetic peptide
  MISC_FEATURE (1)..(1): N-terminal acetylation
  MISC_FEATURE (20)..(20): C-terminal amidation
VYEVGLDHGNWYEIIWRYPS

SEQ ID NO: 1912 - protein, 20 aa, Artificial Sequence
  Synthetic peptide
  MISC_FEATURE (1)..(1): N-terminal acetylation
  MISC_FEATURE (20)..(20): C-terminal amidation
VYEVGWLHGNWYEIIWRYPS

SEQ ID NO: 1913 - protein, 20 aa, Artificial Sequence
  Synthetic peptide
  MISC_FEATURE (1)..(1): N-terminal acetylation
  MISC_FEATURE (20)..(20): C-terminal amidation
VYEVGWDLGNWYEIIWRYPS

SEQ ID NO: 1914 - protein, 20 aa, Artificial Sequence
  Synthetic peptide
  MISC_FEATURE (1)..(1): N-terminal acetylation
  MISC_FEATURE (20)..(20): C-terminal amidation
VYEVGWDHLNWYEIIWRYPS

SEQ ID NO: 1915 - protein, 20 aa, Artificial Sequence
  Synthetic peptide
  MISC_FEATURE (1)..(1): N-terminal acetylation
  MISC_FEATURE (20)..(20): C-terminal amidation
VYEVGWDHGLWYEIIWRYPS

SEQ ID NO: 1916 - protein, 20 aa, Artificial Sequence
  Synthetic peptide
  MISC_FEATURE (1)..(1): N-terminal acetylation
  MISC_FEATURE (20)..(20): C-terminal amidation
VYEVGWDHGNLYEIIWRYPS

SEQ ID NO: 1917 - protein, 20 aa, Artificial Sequence
  Synthetic peptide
  MISC_FEATURE (1)..(1): N-terminal acetylation
  MISC_FEATURE (20)..(20): C-terminal amidation
VYEVGWDHGNWLEIIWRYPS

SEQ ID NO: 1918 - protein, 20 aa, Artificial Sequence
  Synthetic peptide
  MISC_FEATURE (1)..(1): N-terminal acetylation
  MISC_FEATURE (20)..(20): C-terminal amidation
VYEVGWDHGNWYLIIWRYPS

SEQ ID NO: 1919 - protein, 20 aa, Artificial Sequence
  Synthetic peptide
  MISC_FEATURE (1)..(1): N-terminal acetylation
  MISC_FEATURE (20)..(20): C-terminal amidation
VYEVGWDHGNWYELIWRYPS

SEQ ID NO: 1920 - protein, 20 aa, Artificial Sequence
  Synthetic peptide
  MISC_FEATURE (1)..(1): N-terminal acetylation
  MISC_FEATURE (20)..(20): C-terminal amidation
VYEVGWDHGNWYEILWRYPS

SEQ ID NO: 1921 - protein, 20 aa, Artificial Sequence
  Synthetic peptide
  MISC_FEATURE (1)..(1): N-terminal acetylation
  MISC_FEATURE (20)..(20): C-terminal amidation
VYEVGWDHGNWYEIILRYPS

SEQ ID NO: 1922 - protein, 20 aa, Artificial Sequence
  Synthetic peptide
  MISC_FEATURE (1)..(1): N-terminal acetylation
  MISC_FEATURE (20)..(20): C-terminal amidation
VYEVGWDHGNWYEIIWLYPS

SEQ ID NO: 1923 - protein, 20 aa, Artificial Sequence
  Synthetic peptide
  MISC_FEATURE (1)..(1): N-terminal acetylation
  MISC_FEATURE (20)..(20): C-terminal amidation
VYEVGWDHGNWYEIIWRLPS

SEQ ID NO: 1924 - protein, 20 aa, Artificial Sequence
  Synthetic peptide
  MISC_FEATURE (1)..(1): N-terminal acetylation
  MISC_FEATURE (20)..(20): C-terminal amidation
VYEVGWDHGNWYEIIWRYLS

SEQ ID NO: 1925 - protein, 20 aa, Artificial Sequence
  Synthetic peptide
  MISC_FEATURE (1)..(1): N-terminal acetylation
  MISC_FEATURE (20)..(20): C-terminal amidation
VYEVGWDHGNWYEIIWRYPL

SEQ ID NO: 1926 - protein, 20 aa, Artificial Sequence
  Synthetic peptide
  MISC_FEATURE (1)..(1): N-terminal acetylation
  MISC_FEATURE (20)..(20): C-terminal amidation
KYEVGWDHGNWYEIIWRYPS

SEQ ID NO: 1927 - protein, 20 aa, Artificial Sequence
  Synthetic peptide
  MISC_FEATURE (1)..(1): N-terminal acetylation
  MISC_FEATURE (20)..(20): C-terminal amidation
VKEVGWDHGNWYEIIWRYPS

SEQ ID NO: 1928 - protein, 20 aa, Artificial Sequence
  Synthetic peptide
  MISC_FEATURE (1)..(1): N-terminal acetylation
  MISC_FEATURE (20)..(20): C-terminal amidation
VYKVGWDHGNWYEIIWRYPS

SEQ ID NO: 1929 - protein, 20 aa, Artificial Sequence
  Synthetic peptide
  MISC_FEATURE (1)..(1): N-terminal acetylation
  MISC_FEATURE (20)..(20): C-terminal amidation
VYEKGWDHGNWYEIIWRYPS

SEQ ID NO: 1930 - protein, 20 aa, Artificial Sequence
  Synthetic peptide
  MISC_FEATURE (1)..(1): N-terminal acetylation
  MISC_FEATURE (20)..(20): C-terminal amidation
VYEVKWDHGNWYEIIWRYPS

SEQ ID NO: 1931 - protein, 20 aa, Artificial Sequence
  Synthetic peptide
  MISC_FEATURE (1)..(1): N-terminal acetylation
  MISC_FEATURE (20)..(20): C-terminal amidation
VYEVGKDHGNWYEIIWRYPS

SEQ ID NO: 1932 - protein, 20 aa, Artificial Sequence
  Synthetic peptide
  MISC_FEATURE (1)..(1): N-terminal acetylation
  MISC_FEATURE (20)..(20): C-terminal amidation
VYEVGWKHGNWYEIIWRYPS

SEQ ID NO: 1933 - protein, 20 aa, Artificial Sequence
  Synthetic peptide
  MISC_FEATURE (1)..(1): N-terminal acetylation
  MISC_FEATURE (20)..(20): C-terminal amidation
VYEVGWDKGNWYEIIWRYPS

SEQ ID NO: 1934 - protein, 20 aa, Artificial Sequence
  Synthetic peptide
  MISC_FEATURE (1)..(1): N-terminal acetylation
  MISC_FEATURE (20)..(20): C-terminal amidation
VYEVGWDHKNWYEIIWRYPS

SEQ ID NO: 1935 - protein, 20 aa, Artificial Sequence
  Synthetic peptide
  MISC_FEATURE (1)..(1): N-terminal acetylation
  MISC_FEATURE (20)..(20): C-terminal amidation
VYEVGWDHGKWYEIIWRYPS

SEQ ID NO: 1936 - protein, 20 aa, Artificial Sequence
  Synthetic peptide
  MISC_FEATURE (1)..(1): N-terminal acetylation
  MISC_FEATURE (20)..(20): C-terminal amidation
VYEVGWDHGNKYEIIWRYPS

SEQ ID NO: 1937 - protein, 20 aa, Artificial Sequence
  Synthetic peptide
  MISC_FEATURE (1)..(1): N-terminal acetylation
  MISC_FEATURE (20)..(20): C-terminal amidation
VYEVGWDHGNWKEIIWRYPS

SEQ ID NO: 1938 - protein, 20 aa, Artificial Sequence
  Synthetic peptide
  MISC_FEATURE (1)..(1): N-terminal acetylation
  MISC_FEATURE (20)..(20): C-terminal amidation
VYEVGWDHGNWYKIIWRYPS

SEQ ID NO: 1939 - protein, 20 aa, Artificial Sequence
  Synthetic peptide
  MISC_FEATURE (1)..(1): N-terminal acetylation
  MISC_FEATURE (20)..(20): C-terminal amidation
VYEVGWDHGNWYEKIWRYPS

SEQ ID NO: 1940 - protein, 20 aa, Artificial Sequence
  Synthetic peptide
  MISC_FEATURE (1)..(1): N-terminal acetylation
  MISC_FEATURE (20)..(20): C-terminal amidation
VYEVGWDHGNWYEIKWRYPS

SEQ ID NO: 1941 - protein, 20 aa, Artificial Sequence
  Synthetic peptide
  MISC_FEATURE (1)..(1): N-terminal acetylation
  MISC_FEATURE (20)..(20): C-terminal amidation
VYEVGWDHGNWYEIIKRYPS

SEQ ID NO: 1942 - protein, 20 aa, Artificial Sequence
  Synthetic peptide
  MISC_FEATURE (1)..(1): N-terminal acetylation
  MISC_FEATURE (20)..(20): C-terminal amidation
VYEVGWDHGNWYEIIWKYPS

SEQ ID NO: 1943 - protein, 20 aa, Artificial Sequence
  Synthetic peptide
  MISC_FEATURE (1)..(1): N-terminal acetylation
  MISC_FEATURE (20)..(20): C-terminal amidation
VYEVGWDHGNWYEIIWRKPS

SEQ ID NO: 1944 - protein, 20 aa, Artificial Sequence
  Synthetic peptide
  MISC_FEATURE (1)..(1): N-terminal acetylation
  MISC_FEATURE (20)..(20): C-terminal amidation
VYEVGWDHGNWYEIIWRYKS

SEQ ID NO: 1945 - protein, 20 aa, Artificial Sequence
  Synthetic peptide
  MISC_FEATURE (1)..(1): N-terminal acetylation
  MISC_FEATURE (20)..(20): C-terminal amidation
VYEVGWDHGNWYEIIWRYPK

SEQ ID NO: 1946 - protein, 20 aa, Artificial Sequence
  Synthetic peptide
  MISC_FEATURE (1)..(1): N-terminal acetylation
  MISC_FEATURE (20)..(20): C-terminal amidation
FYEVGWDHGNWYEIIWRYPS

SEQ ID NO: 1947 - protein, 20 aa, Artificial Sequence
  Synthetic peptide
  MISC_FEATURE (1)..(1): N-terminal acetylation
  MISC_FEATURE (20)..(20): C-terminal amidation
VFEVGWDHGNWYEIIWRYPS

SEQ ID NO: 1948 - protein, 20 aa, Artificial Sequence
  Synthetic peptide
  MISC_FEATURE (1)..(1): N-terminal acetylation
  MISC_FEATURE (20)..(20): C-terminal amidation
VYFVGWDHGNWYEIIWRYPS

SEQ ID NO: 1949 - protein, 20 aa, Artificial Sequence
  Synthetic peptide
  MISC_FEATURE (1)..(1): N-terminal acetylation
  MISC_FEATURE (20)..(20): C-terminal amidation
VYEFGWDHGNWYEIIWRYPS

SEQ ID NO: 1950 - protein, 20 aa, Artificial Sequence
  Synthetic peptide
  MISC_FEATURE (1)..(1): N-terminal acetylation
  MISC_FEATURE (20)..(20): C-terminal amidation
VYEVFWDHGNWYEIIWRYPS

SEQ ID NO: 1951 - protein, 20 aa, Artificial Sequence
  Synthetic peptide
  MISC_FEATURE (1)..(1): N-terminal acetylation
  MISC_FEATURE (20)..(20): C-terminal amidation
VYEVGFDHGNWYEIIWRYPS

SEQ ID NO: 1952 - protein, 20 aa, Artificial Sequence
  Synthetic peptide
  MISC_FEATURE (1)..(1): N-terminal acetylation
  MISC_FEATURE (20)..(20): C-terminal amidation
VYEVGWFHGNWYEIIWRYPS

SEQ ID NO: 1953 - protein, 20 aa, Artificial Sequence
  Synthetic peptide
  MISC_FEATURE (1)..(1): N-terminal acetylation
  MISC_FEATURE (20)..(20): C-terminal amidation
VYEVGWDFGNWYEIIWRYPS

SEQ ID NO: 1954 - protein, 20 aa, Artificial Sequence
  Synthetic peptide
  MISC_FEATURE (1)..(1): N-terminal acetylation
  MISC_FEATURE (20)..(20): C-terminal amidation
VYEVGWDHFNWYEIIWRYPS

SEQ ID NO: 1955 - protein, 20 aa, Artificial Sequence
  Synthetic peptide
  MISC_FEATURE (1)..(1): N-terminal acetylation
  MISC_FEATURE (20)..(20): C-terminal amidation
VYEVGWDHGFWYEIIWRYPS

SEQ ID NO: 1956 - protein, 20 aa, Artificial Sequence
  Synthetic peptide
  MISC_FEATURE (1)..(1): N-terminal acetylation
  MISC_FEATURE (20)..(20): C-terminal amidation
VYEVGWDHGNFYEIIWRYPS

SEQ ID NO: 1957 - protein, 20 aa, Artificial Sequence
  Synthetic peptide
  MISC_FEATURE (1)..(1): N-terminal acetylation
  MISC_FEATURE (20)..(20): C-terminal amidation
VYEVGWDHGNWFEIIWRYPS

SEQ ID NO: 1958 - protein, 20 aa, Artificial Sequence
  Synthetic peptide
  MISC_FEATURE (1)..(1): N-terminal acetylation
  MISC_FEATURE (20)..(20): C-terminal amidation
VYEVGWDHGNWYFIIWRYPS

SEQ ID NO: 1959 - protein, 20 aa, Artificial Sequence
  Synthetic peptide
  MISC_FEATURE (1)..(1): N-terminal acetylation
  MISC_FEATURE (20)..(20): C-terminal amidation
VYEVGWDHGNWYEFIWRYPS

SEQ ID NO: 1960 - protein, 20 aa, Artificial Sequence
  Synthetic peptide
  MISC_FEATURE (1)..(1): N-terminal acetylation
  MISC_FEATURE (20)..(20): C-terminal amidation
VYEVGWDHGNWYEIFWRYPS

SEQ ID NO: 1961 - protein, 20 aa, Artificial Sequence
  Synthetic peptide
  MISC_FEATURE (1)..(1): N-terminal acetylation
  MISC_FEATURE (20)..(20): C-terminal amidation
VYEVGWDHGNWYEIIFRYPS

SEQ ID NO: 1962 - protein, 20 aa, Artificial Sequence
  Synthetic peptide
  MISC_FEATURE (1)..(1): N-terminal acetylation
  MISC_FEATURE (20)..(20): C-terminal amidation
VYEVGWDHGNWYEIIWFYPS

SEQ ID NO: 1963 - protein, 20 aa, Artificial Sequence
  Synthetic peptide
  MISC_FEATURE (1)..(1): N-terminal acetylation
  MISC_FEATURE (20)..(20): C-terminal amidation
VYEVGWDHGNWYEIIWRFPS

SEQ ID NO: 1964 - protein, 20 aa, Artificial Sequence
  Synthetic peptide
  MISC_FEATURE (1)..(1): N-terminal acetylation
  MISC_FEATURE (20)..(20): C-terminal amidation
VYEVGWDHGNWYEIIWRYFS

SEQ ID NO: 1965 - protein, 20 aa, Artificial Sequence
  Synthetic peptide
  MISC_FEATURE (1)..(1): N-terminal acetylation
  MISC_FEATURE (20)..(20): C-terminal amidation
VYEVGWDHGNWYEIIWRYPF

SEQ ID NO: 1966 - protein, 20 aa, Artificial Sequence
  Synthetic peptide
  MISC_FEATURE (1)..(1): N-terminal acetylation
  MISC_FEATURE (20)..(20): C-terminal amidation
PYEVGWDHGNWYEIIWRYPS

SEQ ID NO: 1967 - protein, 20 aa, Artificial Sequence
  Synthetic peptide
  MISC_FEATURE (1)..(1): N-terminal acetylation
  MISC_FEATURE (20)..(20): C-terminal amidation
VPEVGWDHGNWYEIIWRYPS

SEQ ID NO: 1968 - protein, 20 aa, Artificial Sequence
  Synthetic peptide
  MISC_FEATURE (1)..(1): N-terminal acetylation
  MISC_FEATURE (20)..(20): C-terminal amidation
VYPVGWDHGNWYEIIWRYPS

SEQ ID NO: 1969 - protein, 20 aa, Artificial Sequence
  Synthetic peptide
  MISC_FEATURE (1)..(1): N-terminal acetylation
  MISC_FEATURE (20)..(20): C-terminal amidation
VYEPGWDHGNWYEIIWRYPS

SEQ ID NO: 1970 - protein, 20 aa, Artificial Sequence
  Synthetic peptide
  MISC_FEATURE (1)..(1): N-terminal acetylation
  MISC_FEATURE (20)..(20): C-terminal amidation
VYEVPWDHGNWYEIIWRYPS

SEQ ID NO: 1971 - protein, 20 aa, Artificial Sequence
  Synthetic peptide
  MISC_FEATURE (1)..(1): N-terminal acetylation
  MISC_FEATURE (20)..(20): C-terminal amidation
VYEVGPDHGNWYEIIWRYPS

SEQ ID NO: 1972 - protein, 20 aa, Artificial Sequence
  Synthetic peptide
  MISC_FEATURE (1)..(1): N-terminal acetylation
  MISC_FEATURE (20)..(20): C-terminal amidation
VYEVGWPHGNWYEIIWRYPS

SEQ ID NO: 1973 - protein, 20 aa, Artificial Sequence
  Synthetic peptide
  MISC_FEATURE (1)..(1): N-terminal acetylation
  MISC_FEATURE (20)..(20): C-terminal amidation
VYEVGWDPGNWYEIIWRYPS

SEQ ID NO: 1974 - protein, 20 aa, Artificial Sequence
  Synthetic peptide
  MISC_FEATURE (1)..(1): N-terminal acetylation
  MISC_FEATURE (20)..(20): C-terminal amidation
VYEVGWDHPNWYEIIWRYPS

SEQ ID NO: 1975 - protein, 20 aa, Artificial Sequence
  Synthetic peptide
  MISC_FEATURE (1)..(1): N-terminal acetylation
  MISC_FEATURE (20)..(20): C-terminal amidation
VYEVGWDHGPWYEIIWRYPS

SEQ ID NO: 1976 - protein, 20 aa, Artificial Sequence
  Synthetic peptide
  MISC_FEATURE (1)..(1): N-terminal acetylation
  MISC_FEATURE (20)..(20): C-terminal amidation
VYEVGWDHGNPYEIIWRYPS

SEQ ID NO: 1977 - protein, 20 aa, Artificial Sequence
  Synthetic peptide
  MISC_FEATURE (1)..(1): N-terminal acetylation
  MISC_FEATURE (20)..(20): C-terminal amidation
VYEVGWDHGNWPEIIWRYPS

SEQ ID NO: 1978 - protein, 20 aa, Artificial Sequence
  Synthetic peptide
  MISC_FEATURE (1)..(1): N-terminal acetylation
  MISC_FEATURE (20)..(20): C-terminal amidation
VYEVGWDHGNWYPIIWRYPS

SEQ ID NO: 1979 - protein, 20 aa, Artificial Sequence
  Synthetic peptide
  MISC_FEATURE (1)..(1): N-terminal acetylation
  MISC_FEATURE (20)..(20): C-terminal amidation
VYEVGWDHGNWYEPIWRYPS

SEQ ID NO: 1980 - protein, 20 aa, Artificial Sequence
  Synthetic peptide
  MISC_FEATURE (1)..(1): N-terminal acetylation
  MISC_FEATURE (20)..(20): C-terminal amidation
VYEVGWDHGNWYEIPWRYPS

SEQ ID NO: 1981 - protein, 20 aa, Artificial Sequence
  Synthetic peptide
  MISC_FEATURE (1)..(1): N-terminal acetylation
  MISC_FEATURE (20)..(20): C-terminal amidation
VYEVGWDHGNWYEIIPRYPS

SEQ ID NO: 1982 - protein, 20 aa, Artificial Sequence
  Synthetic peptide
  MISC_FEATURE (1)..(1): N-terminal acetylation
  MISC_FEATURE (20)..(20): C-terminal amidation
VYEVGWDHGNWYEIIWPYPS

SEQ ID NO: 1983 - protein, 20 aa, Artificial Sequence
  Synthetic peptide
  MISC_FEATURE (1)..(1): N-terminal acetylation
  MISC_FEATURE (20)..(20): C-terminal amidation
VYEVGWDHGNWYEIIWRPPS

SEQ ID NO: 1984 - protein, 20 aa, Artificial Sequence
  Synthetic peptide
  MISC_FEATURE (1)..(1): N-terminal acetylation
  MISC_FEATURE (20)..(20): C-terminal amidation
VYEVGWDHGNWYEIIWRYPP

SEQ ID NO: 1985 - protein, 20 aa, Artificial Sequence
  Synthetic peptide
  MISC_FEATURE (1)..(1): N-terminal acetylation
  MISC_FEATURE (20)..(20): C-terminal amidation
SYEVGWDHGNWYEIIWRYPS

SEQ ID NO: 1986 - protein, 20 aa, Artificial Sequence
  Synthetic peptide
  MISC_FEATURE (1)..(1): N-terminal acetylation
  MISC_FEATURE (20)..(20): C-terminal amidation
VSEVGWDHGNWYEIIWRYPS

SEQ ID NO: 1987 - protein, 20 aa, Artificial Sequence
  Synthetic peptide
  MISC_FEATURE (1)..(1): N-terminal acetylation
  MISC_FEATURE (20)..(20): C-terminal amidation
VYSVGWDHGNWYEIIWRYPS

SEQ ID NO: 1988 - protein, 20 aa, Artificial Sequence
  Synthetic peptide
  MISC_FEATURE (1)..(1): N-terminal acetylation
  MISC_FEATURE (20)..(20): C-terminal amidation
VYESGWDHGNWYEIIWRYPS

SEQ ID NO: 1989 - protein, 20 aa, Artificial Sequence
  Synthetic peptide
  MISC_FEATURE (1)..(1): N-terminal acetylation
  MISC_FEATURE (20)..(20): C-terminal amidation
VYEVSWDHGNWYEIIWRYPS

SEQ ID NO: 1990 - protein, 20 aa, Artificial Sequence
  Synthetic peptide
  MISC_FEATURE (1)..(1): N-terminal acetylation
  MISC_FEATURE (20)..(20): C-terminal amidation
VYEVGSDHGNWYEIIWRYPS

SEQ ID NO: 1991 - protein, 20 aa, Artificial Sequence
  Synthetic peptide
  MISC_FEATURE (1)..(1): N-terminal acetylation
  MISC_FEATURE (20)..(20): C-terminal amidation
VYEVGWSHGNWYEIIWRYPS

SEQ ID NO: 1992 - protein, 20 aa, Artificial Sequence
  Synthetic peptide
  MISC_FEATURE (1)..(1): N-terminal acetylation
  MISC_FEATURE (20)..(20): C-terminal amidation
VYEVGWDSGNWYEIIWRYPS

SEQ ID NO: 1993 - protein, 20 aa, Artificial Sequence
  Synthetic peptide
  MISC_FEATURE (1)..(1): N-terminal acetylation
  MISC_FEATURE (20)..(20): C-terminal amidation
VYEVGWDHSNWYEIIWRYPS

SEQ ID NO: 1994 - protein, 20 aa, Artificial Sequence
  Synthetic peptide
  MISC_FEATURE (1)..(1): N-terminal acetylation
  MISC_FEATURE (20)..(20): C-terminal amidation
VYEVGWDHGSWYEIIWRYPS

SEQ ID NO: 1995 - protein, 20 aa, Artificial Sequence
  Synthetic peptide
  MISC_FEATURE (1)..(1): N-terminal acetylation
  MISC_FEATURE (20)..(20): C-terminal amidation
VYEVGWDHGNSYEIIWRYPS

SEQ ID NO: 1996 - protein, 20 aa, Artificial Sequence
  Synthetic peptide
  MISC_FEATURE (1)..(1): N-terminal acetylation
  MISC_FEATURE (20)..(20): C-terminal amidation
VYEVGWDHGNWSEIIWRYPS

SEQ ID NO: 1997 - protein, 20 aa, Artificial Sequence
  Synthetic peptide
  MISC_FEATURE (1)..(1): N-terminal acetylation
  MISC_FEATURE (20)..(20): C-terminal amidation
VYEVGWDHGNWYSIIWRYPS

SEQ ID NO: 1998 - protein, 20 aa, Artificial Sequence
  Synthetic peptide
  MISC_FEATURE (1)..(1): N-terminal acetylation
  MISC_FEATURE (20)..(20): C-terminal amidation
VYEVGWDHGNWYESIWRYPS

SEQ ID NO: 1999 - protein, 20 aa, Artificial Sequence
  Synthetic peptide
  MISC_FEATURE (1)..(1): N-terminal acetylation
  MISC_FEATURE (20)..(20): C-terminal amidation
VYEVGWDHGNWYEISWRYPS

SEQ ID NO: 2000 - protein, 20 aa, Artificial Sequence
  Synthetic peptide
  MISC_FEATURE (1)..(1): N-terminal acetylation
  MISC_FEATURE (20)..(20): C-terminal amidation
VYEVGWDHGNWYEIISRYPS

SEQ ID NO: 2001 - protein, 20 aa, Artificial Sequence
  Synthetic peptide
  MISC_FEATURE (1)..(1): N-terminal acetylation
  MISC_FEATURE (20)..(20): C-terminal amidation
VYEVGWDHGNWYEIIWSYPS

SEQ ID NO: 2002 - protein, 20 aa, Artificial Sequence
  Synthetic peptide
  MISC_FEATURE (1)..(1): N-terminal acetylation
  MISC_FEATURE (20)..(20): C-terminal amidation
VYEVGWDHGNWYEIIWRSPS

SEQ ID NO: 2003 - protein, 20 aa, Artificial Sequence
  Synthetic peptide
  MISC_FEATURE (1)..(1): N-terminal acetylation
  MISC_FEATURE (20)..(20): C-terminal amidation
VYEVGWDHGNWYEIIWRYSS

SEQ ID NO: 2004 - protein, 17 aa, Artificial Sequence
  Synthetic peptide
  MISC_FEATURE (1)..(1): N-terminal acetylation
  MISC_FEATURE (17)..(17): C-terminal amidation
VYEVGWDHGNWYEIIWR

SEQ ID NO: 2005 - protein, 14 aa, Artificial Sequence
  Synthetic peptide
  MISC_FEATURE (1)..(1): N-terminal acetylation
  MISC_FEATURE (14)..(14): C-terminal amidation
VYEVGWDHGNWYEI

SEQ ID NO: 2006 - protein, 11 aa, Artificial Sequence
  Synthetic peptide
  MISC_FEATURE (1)..(1): N-terminal acetylation
  MISC_FEATURE (11)..(11): C-terminal amidation
VYEVGWDHGNW

SEQ ID NO: 2007 - protein, 17 aa, Artificial Sequence
  Synthetic peptide
  MISC_FEATURE (1)..(1): N-terminal acetylation
  MISC_FEATURE (17)..(17): C-terminal amidation
VGWDHGNWYEIIWRYPS

SEQ ID NO: 2008 - protein, 14 aa, Artificial Sequence
  Synthetic peptide
  MISC_FEATURE (1)..(1): N-terminal acetylation
  MISC_FEATURE (14)..(14): C-terminal amidation
DHGNWYEIIWRYPS

SEQ ID NO: 2009 - protein, 11 aa, Artificial Sequence
  Synthetic peptide
  MISC_FEATURE (1)..(1): N-terminal acetylation
  MISC_FEATURE (11)..(11): C-terminal amidation
NWYEIIWRYPS

SEQ ID NO: 2010 - protein, 14 aa, Artificial Sequence
  Synthetic peptide
  MISC_FEATURE (1)..(1): N-terminal acetylation
  MISC_FEATURE (14)..(14): C-terminal amidation
VGWDHGNWYEIIWR

SEQ ID NO: 2011 - protein, 20 aa, Artificial Sequence
  Synthetic peptide
  MISC_FEATURE (1)..(1): N-terminal acetylation
  MISC_FEATURE (20)..(20): C-terminal amidation
ATVEVGWHTVHTGRDNYMWM

SEQ ID NO: 2012 - protein, 20 aa, Artificial Sequence
  Synthetic peptide
  MISC_FEATURE (1)..(1): N-terminal acetylation
  MISC_FEATURE (20)..(20): C-terminal amidation
YAVEVGWHTVHTGRDNYMWM

SEQ ID NO: 2013 - protein, 20 aa, Artificial Sequence
  Synthetic peptide
  MISC_FEATURE (1)..(1): N-terminal acetylation
  MISC_FEATURE (20)..(20): C-terminal amidation
YTAEVGWHTVHTGRDNYMWM

SEQ ID NO: 2014 - protein, 20 aa, Artificial Sequence
  Synthetic peptide
  MISC_FEATURE (1)..(1): N-terminal acetylation
  MISC_FEATURE (20)..(20): C-terminal amidation
YTVAVGWHTVHTGRDNYMWM

SEQ ID NO: 2015 - protein, 20 aa, Artificial Sequence
  Synthetic peptide
  MISC_FEATURE (1)..(1): N-terminal acetylation
  MISC_FEATURE (20)..(20): C-terminal amidation
YTVEAGWHTVHTGRDNYMWM

SEQ ID NO: 2016 - protein, 20 aa, Artificial Sequence
  Synthetic peptide
  MISC_FEATURE (1)..(1): N-terminal acetylation
  MISC_FEATURE (20)..(20): C-terminal amidation
YTVEVAWHTVHTGRDNYMWM

SEQ ID NO: 2017 - protein, 20 aa, Artificial Sequence
  Synthetic peptide
  MISC_FEATURE (1)..(1): N-terminal acetylation
  MISC_FEATURE (20)..(20): C-terminal amidation
YTVEVGAHTVHTGRDNYMWM

SEQ ID NO: 2018 - protein, 20 aa, Artificial Sequence
  Synthetic peptide
  MISC_FEATURE (1)..(1): N-terminal acetylation
  MISC_FEATURE (20)..(20): C-terminal amidation
YTVEVGWATVHTGRDNYMWM

SEQ ID NO: 2019 - protein, 20 aa, Artificial Sequence
  Synthetic peptide
  MISC_FEATURE (1)..(1): N-terminal acetylation
  MISC_FEATURE (20)..(20): C-terminal amidation
YTVEVGWHAVHTGRDNYMWM

SEQ ID NO: 2020 - protein, 20 aa, Artificial Sequence
  Synthetic peptide
  MISC_FEATURE (1)..(1): N-terminal acetylation
  MISC_FEATURE (20)..(20): C-terminal amidation
YTVEVGWHTAHTGRDNYMWM

SEQ ID NO: 2021 - protein, 20 aa, Artificial Sequence
  Synthetic peptide
  MISC_FEATURE (1)..(1): N-terminal acetylation
  MISC_FEATURE (20)..(20): C-terminal amidation
YTVEVGWHTVATGRDNYMWM

SEQ ID NO: 2022 - protein, 20 aa, Artificial Sequence
  Synthetic peptide
  MISC_FEATURE (1)..(1): N-terminal acetylation
  MISC_FEATURE (20)..(20): C-terminal amidation
YTVEVGWHTVHAGRDNYMWM

SEQ ID NO: 2023 - protein, 20 aa, Artificial Sequence
  Synthetic peptide
  MISC_FEATURE (1)..(1): N-terminal acetylation
  MISC_FEATURE (20)..(20): C-terminal amidation
YTVEVGWHTVHTARDNYMWM

SEQ ID NO: 2024 - protein, 20 aa, Artificial Sequence
  Synthetic peptide
  MISC_FEATURE (1)..(1): N-terminal acetylation
  MISC_FEATURE (20)..(20): C-terminal amidation
YTVEVGWHTVHTGADNYMWM

SEQ ID NO: 2025 - protein, 20 aa, Artificial Sequence
  Synthetic peptide
  MISC_FEATURE (1)..(1): N-terminal acetylation
  MISC_FEATURE (20)..(20): C-terminal amidation
YTVEVGWHTVHTGRANYMWM

SEQ ID NO: 2026 - protein, 20 aa, Artificial Sequence
  Synthetic peptide
  MISC_FEATURE (1)..(1): N-terminal acetylation
  MISC_FEATURE (20)..(20): C-terminal amidation
YTVEVGWHTVHTGRDAYMWM

SEQ ID NO: 2027 - protein, 20 aa, Artificial Sequence
  Synthetic peptide
  MISC_FEATURE (1)..(1): N-terminal acetylation
  MISC_FEATURE (20)..(20): C-terminal amidation
YTVEVGWHTVHTGRDNAMWM

SEQ ID NO: 2028 - protein, 20 aa, Artificial Sequence
  Synthetic peptide
  MISC_FEATURE (1)..(1): N-terminal acetylation
  MISC_FEATURE (20)..(20): C-terminal amidation
YTVEVGWHTVHTGRDNYAWM

SEQ ID NO: 2029 - protein, 20 aa, Artificial Sequence
  Synthetic peptide
  MISC_FEATURE (1)..(1): N-terminal acetylation
  MISC_FEATURE (20)..(20): C-terminal amidation
YTVEVGWHTVHTGRDNYMAM

SEQ ID NO: 2030 - protein, 20 aa, Artificial Sequence
  Synthetic peptide
  MISC_FEATURE (1)..(1): N-terminal acetylation
  MISC_FEATURE (20)..(20): C-terminal amidation
YTVEVGWHTVHTGRDNYMWA

SEQ ID NO: 2031 - protein, 20 aa, Artificial Sequence
  Synthetic peptide
  MISC_FEATURE (1)..(1): N-terminal acetylation
  MISC_FEATURE (20)..(20): C-terminal amidation
DTVEVGWHTVHTGRDNYMWM

SEQ ID NO: 2032 - protein, 20 aa, Artificial Sequence
  Synthetic peptide
  MISC_FEATURE (1)..(1): N-terminal acetylation
  MISC_FEATURE (20)..(20): C-terminal amidation
YDVEVGWHTVHTGRDNYMWM

SEQ ID NO: 2033 - protein, 20 aa, Artificial Sequence
  Synthetic peptide
  MISC_FEATURE (1)..(1): N-terminal acetylation
  MISC_FEATURE (20)..(20): C-terminal amidation
YTDEVGWHTVHTGRDNYMWM

SEQ ID NO: 2034 - protein, 20 aa, Artificial Sequence
  Synthetic peptide
  MISC_FEATURE (1)..(1): N-terminal acetylation
  MISC_FEATURE (20)..(20): C-terminal amidation
YTVDVGWHTVHTGRDNYMWM

SEQ ID NO: 2035 - protein, 20 aa, Artificial Sequence
  Synthetic peptide
  MISC_FEATURE (1)..(1): N-terminal acetylation
  MISC_FEATURE (20)..(20): C-terminal amidation
YTVEDGWHTVHTGRDNYMWM

SEQ ID NO: 2036 - protein, 20 aa, Artificial Sequence
  Synthetic peptide
  MISC_FEATURE (1)..(1): N-terminal acetylation
  MISC_FEATURE (20)..(20): C-terminal amidation
YTVEVDWHTVHTGRDNYMWM

SEQ ID NO: 2037 - protein, 20 aa, Artificial Sequence
  Synthetic peptide
  MISC_FEATURE (1)..(1): N-terminal acetylation
  MISC_FEATURE (20)..(20): C-terminal amidation
YTVEVGDHTVHTGRDNYMWM

SEQ ID NO: 2038 - protein, 20 aa, Artificial Sequence
  Synthetic peptide
  MISC_FEATURE (1)..(1): N-terminal acetylation
  MISC_FEATURE (20)..(20): C-terminal amidation
YTVEVGWDTVHTGRDNYMWM

SEQ ID NO: 2039 - protein, 20 aa, Artificial Sequence
  Synthetic peptide
  MISC_FEATURE (1)..(1): N-terminal acetylation
  MISC_FEATURE (20)..(20): C-terminal amidation
YTVEVGWHDVHTGRDNYMWM

SEQ ID NO: 2040 - protein, 20 aa, Artificial Sequence
  Synthetic peptide
  MISC_FEATURE (1)..(1): N-terminal acetylation
  MISC_FEATURE (20)..(20): C-terminal amidation
YTVEVGWHTDHTGRDNYMWM

SEQ ID NO: 2041 - protein, 20 aa, Artificial Sequence
  Synthetic peptide
  MISC_FEATURE (1)..(1): N-terminal acetylation
  MISC_FEATURE (20)..(20): C-terminal amidation
YTVEVGWHTVDTGRDNYMWM

SEQ ID NO: 2042 - protein, 20 aa, Artificial Sequence
  Synthetic peptide
  MISC_FEATURE (1)..(1): N-terminal acetylation
  MISC_FEATURE (20)..(20): C-terminal amidation
YTVEVGWHTVHDGRDNYMWM

SEQ ID NO: 2043 - protein, 20 aa, Artificial Sequence
  Synthetic peptide
  MISC_FEATURE (1)..(1): N-terminal acetylation
  MISC_FEATURE (20)..(20): C-terminal amidation
YTVEVGWHTVHTDRDNYMWM

SEQ ID NO: 2044 - protein, 20 aa, Artificial Sequence
  Synthetic peptide
  MISC_FEATURE (1)..(1): N-terminal acetylation
  MISC_FEATURE (20)..(20): C-terminal amidation
YTVEVGWHTVHTGDDNYMWM

SEQ ID NO: 2045 - protein, 20 aa, Artificial Sequence
  Synthetic peptide
  MISC_FEATURE (1)..(1): N-terminal acetylation
  MISC_FEATURE (20)..(20): C-terminal amidation
YTVEVGWHTVHTGRDDYMWM

SEQ ID NO: 2046 - protein, 20 aa, Artificial Sequence
  Synthetic peptide
  MISC_FEATURE (1)..(1): N-terminal acetylation
  MISC_FEATURE (20)..(20): C-terminal amidation
YTVEVGWHTVHTGRDNDMWM

SEQ ID NO: 2047 - protein, 20 aa, Artificial Sequence
  Synthetic peptide
  MISC_FEATURE (1)..(1): N-terminal acetylation
  MISC_FEATURE (20)..(20): C-terminal amidation
YTVEVGWHTVHTGRDNYDWM

SEQ ID NO: 2048 - protein, 20 aa, Artificial Sequence
  Synthetic peptide
  MISC_FEATURE (1)..(1): N-terminal acetylation
  MISC_FEATURE (20)..(20): C-terminal amidation
YTVEVGWHTVHTGRDNYMDM

SEQ ID NO: 2049 - protein, 20 aa, Artificial Sequence
  Synthetic peptide
  MISC_FEATURE (1)..(1): N-terminal acetylation
  MISC_FEATURE (20)..(20): C-terminal amidation
YTVEVGWHTVHTGRDNYMWD

SEQ ID NO: 2050 - protein, 20 aa, Artificial Sequence
  Synthetic peptide
  MISC_FEATURE (1)..(1): N-terminal acetylation
  MISC_FEATURE (20)..(20): C-terminal amidation
GTVEVGWHTVHTGRDNYMWM

SEQ ID NO: 2051 - protein, 20 aa, Artificial Sequence
  Synthetic peptide
  MISC_FEATURE (1)..(1): N-terminal acetylation
  MISC_FEATURE (20)..(20): C-terminal amidation
YGVEVGWHTVHTGRDNYMWM

SEQ ID NO: 2052 - protein, 20 aa, Artificial Sequence
  Synthetic peptide
  MISC_FEATURE (1)..(1): N-terminal acetylation
  MISC_FEATURE (20)..(20): C-terminal amidation
YTGEVGWHTVHTGRDNYMWM

SEQ ID NO: 2053 - protein, 20 aa, Artificial Sequence
  Synthetic peptide
  MISC_FEATURE (1)..(1): N-terminal acetylation
  MISC_FEATURE (20)..(20): C-terminal amidation
YTVGVGWHTVHTGRDNYMWM

SEQ ID NO: 2054 - protein, 20 aa, Artificial Sequence
  Synthetic peptide
  MISC_FEATURE (1)..(1): N-terminal acetylation
  MISC_FEATURE (20)..(20): C-terminal amidation
YTVEGGWHTVHTGRDNYMWM

SEQ ID NO: 2055 - protein, 20 aa, Artificial Sequence
  Synthetic peptide
  MISC_FEATURE (1)..(1): N-terminal acetylation
  MISC_FEATURE (20)..(20): C-terminal amidation
YTVEVGGHTVHTGRDNYMWM

SEQ ID NO: 2056 - protein, 20 aa, Artificial Sequence
  Synthetic peptide
  MISC_FEATURE (1)..(1): N-terminal acetylation
  MISC_FEATURE (20)..(20): C-terminal amidation
YTVEVGWGTVHTGRDNYMWM

SEQ ID NO: 2057 - protein, 20 aa, Artificial Sequence
  Synthetic peptide
  MISC_FEATURE (1)..(1): N-terminal acetylation
  MISC_FEATURE (20)..(20): C-terminal amidation
YTVEVGWHGVHTGRDNYMWM

SEQ ID NO: 2058 - protein, 20 aa, Artificial Sequence
  Synthetic peptide
  MISC_FEATURE (1)..(1): N-terminal acetylation
  MISC_FEATURE (20)..(20): C-terminal amidation
YTVEVGWHTGHTGRDNYMWM

SEQ ID NO: 2059 - protein, 20 aa, Artificial Sequence
  Synthetic peptide
  MISC_FEATURE (1)..(1): N-terminal acetylation
  MISC_FEATURE (20)..(20): C-terminal amidation
YTVEVGWHTVGTGRDNYMWM

SEQ ID NO: 2060 - protein, 20 aa, Artificial Sequence
  Synthetic peptide
  MISC_FEATURE (1)..(1): N-terminal acetylation
  MISC_FEATURE (20)..(20): C-terminal amidation
YTVEVGWHTVHGGRDNYMWM

SEQ ID NO: 2061 - protein, 20 aa, Artificial Sequence
  Synthetic peptide
  MISC_FEATURE (1)..(1): N-terminal acetylation
  MISC_FEATURE (20)..(20): C-terminal amidation
YTVEVGWHTVHTGGDNYMWM

SEQ ID NO: 2062 - protein, 20 aa, Artificial Sequence
  Synthetic peptide
  MISC_FEATURE (1)..(1): N-terminal acetylation
  MISC_FEATURE (20)..(20): C-terminal amidation
YTVEVGWHTVHTGRGNYMWM

SEQ ID NO: 2063 - protein, 20 aa, Artificial Sequence
  Synthetic peptide
  MISC_FEATURE (1)..(1): N-terminal acetylation
  MISC_FEATURE (20)..(20): C-terminal amidation
YTVEVGWHTVHTGRDGYMWM

SEQ ID NO: 2064 - protein, 20 aa, Artificial Sequence
  Synthetic peptide
  MISC_FEATURE (1)..(1): N-terminal acetylation
  MISC_FEATURE (20)..(20): C-terminal amidation
YTVEVGWHTVHTGRDNGMWM

SEQ ID NO: 2065 - protein, 20 aa, Artificial Sequence
  Synthetic peptide
  MISC_FEATURE (1)..(1): N-terminal acetylation
  MISC_FEATURE (20)..(20): C-terminal amidation
YTVEVGWHTVHTGRDNYGWM

SEQ ID NO: 2066 - protein, 20 aa, Artificial Sequence
  Synthetic peptide
  MISC_FEATURE (1)..(1): N-terminal acetylation
  MISC_FEATURE (20)..(20): C-terminal amidation
YTVEVGWHTVHTGRDNYMGM

SEQ ID NO: 2067 - protein, 20 aa, Artificial Sequence
  Synthetic peptide
  MISC_FEATURE (1)..(1): N-terminal acetylation
  MISC_FEATURE (20)..(20): C-terminal amidation
YTVEVGWHTVHTGRDNYMWG

SEQ ID NO: 2068 - protein, 20 aa, Artificial Sequence
  Synthetic peptide
  MISC_FEATURE (1)..(1): N-terminal acetylation
  MISC_FEATURE (20)..(20): C-terminal amidation
LTVEVGWHTVHTGRDNYMWM

SEQ ID NO: 2069 - protein, 20 aa, Artificial Sequence
  Synthetic peptide
  MISC_FEATURE (1)..(1): N-terminal acetylation
  MISC_FEATURE (20)..(20): C-terminal amidation
YLVEVGWHTVHTGRDNYMWM

SEQ ID NO: 2070 - protein, 20 aa, Artificial Sequence
  Synthetic peptide
  MISC_FEATURE (1)..(1): N-terminal acetylation
  MISC_FEATURE (20)..(20): C-terminal amidation
YTLEVGWHTVHTGRDNYMWM

SEQ ID NO: 2071 - protein, 20 aa, Artificial Sequence
  Synthetic peptide
  MISC_FEATURE (1)..(1): N-terminal acetylation
  MISC_FEATURE (20)..(20): C-terminal amidation
YTVLVGWHTVHTGRDNYMWM

SEQ ID NO: 2072 - protein, 20 aa, Artificial Sequence
  Synthetic peptide
  MISC_FEATURE (1)..(1): N-terminal acetylation
  MISC_FEATURE (20)..(20): C-terminal amidation
YTVELGWHTVHTGRDNYMWM

SEQ ID NO: 2073 - protein, 20 aa, Artificial Sequence
  Synthetic peptide
  MISC_FEATURE (1)..(1): N-terminal acetylation
  MISC_FEATURE (20)..(20): C-terminal amidation
YTVEVLWHTVHTGRDNYMWM

SEQ ID NO: 2074 - protein, 20 aa, Artificial Sequence
  Synthetic peptide
  MISC_FEATURE (1)..(1): N-terminal acetylation
  MISC_FEATURE (20)..(20): C-terminal amidation
YTVEVGLHTVHTGRDNYMWM

SEQ ID NO: 2075 - protein, 20 aa, Artificial Sequence
  Synthetic peptide
  MISC_FEATURE (1)..(1): N-terminal acetylation
  MISC_FEATURE (20)..(20): C-terminal amidation
YTVEVGWLTVHTGRDNYMWM

SEQ ID NO: 2076 - protein, 20 aa, Artificial Sequence
  Synthetic peptide
  MISC_FEATURE (1)..(1): N-terminal acetylation
  MISC_FEATURE (20)..(20): C-terminal amidation
YTVEVGWHLVHTGRDNYMWM

SEQ ID NO: 2077 - protein, 20 aa, Artificial Sequence
  Synthetic peptide
  MISC_FEATURE (1)..(1): N-terminal acetylation
  MISC_FEATURE (20)..(20): C-terminal amidation
YTVEVGWHTLHTGRDNYMWM

SEQ ID NO: 2078 - protein, 20 aa, Artificial Sequence
  Synthetic peptide
  MISC_FEATURE (1)..(1): N-terminal acetylation
  MISC_FEATURE (20)..(20): C-terminal amidation
YTVEVGWHTVLTGRDNYMWM

SEQ ID NO: 2079 - protein, 20 aa, Artificial Sequence
  Synthetic peptide
  MISC_FEATURE (1)..(1): N-terminal acetylation
  MISC_FEATURE (20)..(20): C-terminal amidation
YTVEVGWHTVHLGRDNYMWM

SEQ ID NO: 2080 - protein, 20 aa, Artificial Sequence
  Synthetic peptide
  MISC_FEATURE (1)..(1): N-terminal acetylation
  MISC_FEATURE (20)..(20): C-terminal amidation
YTVEVGWHTVHTLRDNYMWM

SEQ ID NO: 2081 - protein, 20 aa, Artificial Sequence
  Synthetic peptide
  MISC_FEATURE (1)..(1): N-terminal acetylation
  MISC_FEATURE (20)..(20): C-terminal amidation
YTVEVGWHTVHTGLDNYMWM

SEQ ID NO: 2082 - protein, 20 aa, Artificial Sequence
  Synthetic peptide
  MISC_FEATURE (1)..(1): N-terminal acetylation
  MISC_FEATURE (20)..(20): C-terminal amidation
YTVEVGWHTVHTGRLNYMWM

SEQ ID NO: 2083 - protein, 20 aa, Artificial Sequence
  Synthetic peptide
  MISC_FEATURE (1)..(1): N-terminal acetylation
  MISC_FEATURE (20)..(20): C-terminal amidation
YTVEVGWHTVHTGRDLYMWM

SEQ ID NO: 2084 - protein, 20 aa, Artificial Sequence
  Synthetic peptide
  MISC_FEATURE (1)..(1): N-terminal acetylation
  MISC_FEATURE (20)..(20): C-terminal amidation
YTVEVGWHTVHTGRDNLMWM

SEQ ID NO: 2085 - protein, 20 aa, Artificial Sequence
  Synthetic peptide
  MISC_FEATURE (1)..(1): N-terminal acetylation
  MISC_FEATURE (20)..(20): C-terminal amidation
YTVEVGWHTVHTGRDNYLWM

SEQ ID NO: 2086 - protein, 20 aa, Artificial Sequence
  Synthetic peptide
  MISC_FEATURE (1)..(1): N-terminal acetylation
  MISC_FEATURE (20)..(20): C-terminal amidation
YTVEVGWHTVHTGRDNYMLM

SEQ ID NO: 2087 - protein, 20 aa, Artificial Sequence
  Synthetic peptide
  MISC_FEATURE (1)..(1): N-terminal acetylation
  MISC_FEATURE (20)..(20): C-terminal amidation
YTVEVGWHTVHTGRDNYMWL

SEQ ID NO: 2088 - protein, 20 aa, Artificial Sequence
  Synthetic peptide
  MISC_FEATURE (1)..(1): N-terminal acetylation
  MISC_FEATURE (20)..(20): C-terminal amidation
KTVEVGWHTVHTGRDNYMWM

SEQ ID NO: 2089 - protein, 20 aa, Artificial Sequence
  Synthetic peptide
  MISC_FEATURE (1)..(1): N-terminal acetylation
  MISC_FEATURE (20)..(20): C-terminal amidation
YKVEVGWHTVHTGRDNYMWM

SEQ ID NO: 2090 - protein, 20 aa, Artificial Sequence
  Synthetic peptide
  MISC_FEATURE (1)..(1): N-terminal acetylation
  MISC_FEATURE (20)..(20): C-terminal amidation
YTKEVGWHTVHTGRDNYMWM

SEQ ID NO: 2091 - protein, 20 aa, Artificial Sequence
  Synthetic peptide
  MISC_FEATURE (1)..(1): N-terminal acetylation
  MISC_FEATURE (20)..(20): C-terminal amidation
YTVKVGWHTVHTGRDNYMWM

SEQ ID NO: 2092 - protein, 20 aa, Artificial Sequence
  Synthetic peptide
  MISC_FEATURE (1)..(1): N-terminal acetylation
  MISC_FEATURE (20)..(20): C-terminal amidation
YTVEKGWHTVHTGRDNYMWM

SEQ ID NO: 2093 - protein, 20 aa, Artificial Sequence
  Synthetic peptide
  MISC_FEATURE (1)..(1): N-terminal acetylation
  MISC_FEATURE (20)..(20): C-terminal amidation
YTVEVKWHTVHTGRDNYMWM

SEQ ID NO: 2094 - protein, 20 aa, Artificial Sequence
  Synthetic peptide
  MISC_FEATURE (1)..(1): N-terminal acetylation
  MISC_FEATURE (20)..(20): C-terminal amidation
YTVEVGKHTVHTGRDNYMWM

SEQ ID NO: 2095 - protein, 20 aa, Artificial Sequence
  Synthetic peptide
  MISC_FEATURE (1)..(1): N-terminal acetylation
  MISC_FEATURE (20)..(20): C-terminal amidation
YTVEVGWKTVHTGRDNYMWM

SEQ ID NO: 2096 - protein, 20 aa, Artificial Sequence
  Synthetic peptide
  MISC_FEATURE (1)..(1): N-terminal acetylation
  MISC_FEATURE (20)..(20): C-terminal amidation
YTVEVGWHKVHTGRDNYMWM

SEQ ID NO: 2097 - protein, 20 aa, Artificial Sequence
  Synthetic peptide
  MISC_FEATURE (1)..(1): N-terminal acetylation
  MISC_FEATURE (20)..(20): C-terminal amidation
YTVEVGWHTKHTGRDNYMWM

SEQ ID NO: 2098 - protein, 20 aa, Artificial Sequence
  Synthetic peptide
  MISC_FEATURE (1)..(1): N-terminal acetylation
  MISC_FEATURE (20)..(20): C-terminal amidation
YTVEVGWHTVKTGRDNYMWM

SEQ ID NO: 2099 - protein, 20 aa, Artificial Sequence
  Synthetic peptide
  MISC_FEATURE (1)..(1): N-terminal acetylation
  MISC_FEATURE (20)..(20): C-terminal amidation
YTVEVGWHTVHKGRDNYMWM

SEQ ID NO: 2100 - protein, 20 aa, Artificial Sequence
  Synthetic peptide
  MISC_FEATURE (1)..(1): N-terminal acetylation
  MISC_FEATURE (20)..(20): C-terminal amidation
YTVEVGWHTVHTKRDNYMWM

SEQ ID NO: 2101 - protein, 20 aa, Artificial Sequence
  Synthetic peptide
  MISC_FEATURE (1)..(1): N-terminal acetylation
  MISC_FEATURE (20)..(20): C-terminal amidation
YTVEVGWHTVHTGKDNYMWM

SEQ ID NO: 2102 - protein, 20 aa, Artificial Sequence
  Synthetic peptide
  MISC_FEATURE (1)..(1): N-terminal acetylation
  MISC_FEATURE (20)..(20): C-terminal amidation
YTVEVGWHTVHTGRKNYMWM

SEQ ID NO: 2103 - protein, 20 aa, Artificial Sequence
  Synthetic peptide
  MISC_FEATURE (1)..(1): N-terminal acetylation
  MISC_FEATURE (20)..(20): C-terminal amidation
YTVEVGWHTVHTGRDKYMWM

SEQ ID NO: 2104 - protein, 20 aa, Artificial Sequence
  Synthetic peptide
  MISC_FEATURE (1)..(1): N-terminal acetylation
  MISC_FEATURE (20)..(20): C-terminal amidation
YTVEVGWHTVHTGRDNKMWM

SEQ ID NO: 2105 - protein, 20 aa, Artificial Sequence
  Synthetic peptide
  MISC_FEATURE (1)..(1): N-terminal acetylation
  MISC_FEATURE (20)..(20): C-terminal amidation
YTVEVGWHTVHTGRDNYKWM

SEQ ID NO: 2106 - protein, 20 aa, Artificial Sequence
  Synthetic peptide
  MISC_FEATURE (1)..(1): N-terminal acetylation
  MISC_FEATURE (20)..(20): C-terminal amidation
YTVEVGWHTVHTGRDNYMKM

SEQ ID NO: 2107 - protein, 20 aa, Artificial Sequence
  Synthetic peptide
  MISC_FEATURE (1)..(1): N-terminal acetylation
  MISC_FEATURE (20)..(20): C-terminal amidation
YTVEVGWHTVHTGRDNYMWK

SEQ ID NO: 2108 - protein, 20 aa, Artificial Sequence
  Synthetic peptide
  MISC_FEATURE (1)..(1): N-terminal acetylation
  MISC_FEATURE (20)..(20): C-terminal amidation
FTVEVGWHTVHTGRDNYMWM

SEQ ID NO: 2109 - protein, 20 aa, Artificial Sequence
  Synthetic peptide
  MISC_FEATURE (1)..(1): N-terminal acetylation
  MISC_FEATURE (20)..(20): C-terminal amidation
YFVEVGWHTVHTGRDNYMWM

SEQ ID NO: 2110 - protein, 20 aa, Artificial Sequence
  Synthetic peptide
  MISC_FEATURE (1)..(1): N-terminal acetylation
  MISC_FEATURE (20)..(20): C-terminal amidation
YTFEVGWHTVHTGRDNYMWM

SEQ ID NO: 2111 - protein, 20 aa, Artificial Sequence
  Synthetic peptide
  MISC_FEATURE (1)..(1): N-terminal acetylation
  MISC_FEATURE (20)..(20): C-terminal amidation
YTVFVGWHTVHTGRDNYMWM

SEQ ID NO: 2112 - protein, 20 aa, Artificial Sequence
  Synthetic peptide
  MISC_FEATURE (1)..(1): N-terminal acetylation
  MISC_FEATURE (20)..(20): C-terminal amidation
YTVEFGWHTVHTGRDNYMWM

SEQ ID NO: 2113 - protein, 20 aa, Artificial Sequence
  Synthetic peptide
  MISC_FEATURE (1)..(1): N-terminal acetylation
  MISC_FEATURE (20)..(20): C-terminal amidation
YTVEVFWHTVHTGRDNYMWM

SEQ ID NO: 2114 - protein, 20 aa, Artificial Sequence
  Synthetic peptide
  MISC_FEATURE (1)..(1): N-terminal acetylation
  MISC_FEATURE (20)..(20): C-terminal amidation
YTVEVGFHTVHTGRDNYMWM

SEQ ID NO: 2115 - protein, 20 aa, Artificial Sequence
  Synthetic peptide
  MISC_FEATURE (1)..(1): N-terminal acetylation
  MISC_FEATURE (20)..(20): C-terminal amidation
YTVEVGWFTVHTGRDNYMWM

SEQ ID NO: 2116 - protein, 20 aa, Artificial Sequence
  Synthetic peptide
  MISC_FEATURE (1)..(1): N-terminal acetylation
  MISC_FEATURE (20)..(20): C-terminal amidation
YTVEVGWHFVHTGRDNYMWM

SEQ ID NO: 2117 - protein, 20 aa, Artificial Sequence
  Synthetic peptide
  MISC_FEATURE (1)..(1): N-terminal acetylation
  MISC_FEATURE (20)..(20): C-terminal amidation
YTVEVGWHTFHTGRDNYMWM

SEQ ID NO: 2118 - protein, 20 aa, Artificial Sequence
  Synthetic peptide
  MISC_FEATURE (1)..(1): N-terminal acetylation
  MISC_FEATURE (20)..(20): C-terminal amidation
YTVEVGWHTVFTGRDNYMWM

SEQ ID NO: 2119 - protein, 20 aa, Artificial Sequence
  Synthetic peptide
  MISC_FEATURE (1)..(1): N-terminal acetylation
  MISC_FEATURE (20)..(20): C-terminal amidation
YTVEVGWHTVHFGRDNYMWM

SEQ ID NO: 2120 - protein, 20 aa, Artificial Sequence
  Synthetic peptide
  MISC_FEATURE (1)..(1): N-terminal acetylation
  MISC_FEATURE (20)..(20): C-terminal amidation
YTVEVGWHTVHTFRDNYMWM

SEQ ID NO: 2121 - protein, 20 aa, Artificial Sequence
  Synthetic peptide
  MISC_FEATURE (1)..(1): N-terminal acetylation
  MISC_FEATURE (20)..(20): C-terminal amidation
YTVEVGWHTVHTGFDNYMWM

SEQ ID NO: 2122 - protein, 20 aa, Artificial Sequence
  Synthetic peptide
  MISC_FEATURE (1)..(1): N-terminal acetylation
  MISC_FEATURE (20)..(20): C-terminal amidation
YTVEVGWHTVHTGRFNYMWM

SEQ ID NO: 2123 - protein, 20 aa, Artificial Sequence
  Synthetic peptide
  MISC_FEATURE (1)..(1): N-terminal acetylation
  MISC_FEATURE (20)..(20): C-terminal amidation
YTVEVGWHTVHTGRDFYMWM

SEQ ID NO: 2124 - protein, 20 aa, Artificial Sequence
  Synthetic peptide
  MISC_FEATURE (1)..(1): N-terminal acetylation
  MISC_FEATURE (20)..(20): C-terminal amidation
YTVEVGWHTVHTGRDNFMWM

SEQ ID NO: 2125 - protein, 20 aa, Artificial Sequence
  Synthetic peptide
  MISC_FEATURE (1)..(1): N-terminal acetylation
  MISC_FEATURE (20)..(20): C-terminal amidation
YTVEVGWHTVHTGRDNYFWM

SEQ ID NO: 2126 - protein, 20 aa, Artificial Sequence
  Synthetic peptide
  MISC_FEATURE (1)..(1): N-terminal acetylation
  MISC_FEATURE (20)..(20): C-terminal amidation
YTVEVGWHTVHTGRDNYMFM

SEQ ID NO: 2127 - protein, 20 aa, Artificial Sequence
  Synthetic peptide
  MISC_FEATURE (1)..(1): N-terminal acetylation
  MISC_FEATURE (20)..(20): C-terminal amidation
YTVEVGWHTVHTGRDNYMWF

SEQ ID NO: 2128 - protein, 20 aa, Artificial Sequence
  Synthetic peptide
  MISC_FEATURE (1)..(1): N-terminal acetylation
  MISC_FEATURE (20)..(20): C-terminal amidation
PTVEVGWHTVHTGRDNYMWM

SEQ ID NO: 2129 - protein, 20 aa, Artificial Sequence
  Synthetic peptide
  MISC_FEATURE (1)..(1): N-terminal acetylation
  MISC_FEATURE (20)..(20): C-terminal amidation
YPVEVGWHTVHTGRDNYMWM

SEQ ID NO: 2130 - protein, 20 aa, Artificial Sequence
  Synthetic peptide
  MISC_FEATURE (1)..(1): N-terminal acetylation
  MISC_FEATURE (20)..(20): C-terminal amidation
YTPEVGWHTVHTGRDNYMWM

SEQ ID NO: 2131 - protein, 20 aa, Artificial Sequence
  Synthetic peptide
  MISC_FEATURE (1)..(1): N-terminal acetylation
  MISC_FEATURE (20)..(20): C-terminal amidation
YTVPVGWHTVHTGRDNYMWM

SEQ ID NO: 2132 - protein, 20 aa, Artificial Sequence
  Synthetic peptide
  MISC_FEATURE (1)..(1): N-terminal acetylation
  MISC_FEATURE (20)..(20): C-terminal amidation
YTVEPGWHTVHTGRDNYMWM

SEQ ID NO: 2133 - protein, 20 aa, Artificial Sequence
  Synthetic peptide
  MISC_FEATURE (1)..(1): N-terminal acetylation
  MISC_FEATURE (20)..(20): C-terminal amidation
YTVEVPWHTVHTGRDNYMWM

SEQ ID NO: 2134 - protein, 20 aa, Artificial Sequence
  Synthetic peptide
  MISC_FEATURE (1)..(1): N-terminal acetylation
  MISC_FEATURE (20)..(20): C-terminal amidation
YTVEVGPHTVHTGRDNYMWM

SEQ ID NO: 2135 - protein, 20 aa, Artificial Sequence
  Synthetic peptide
  MISC_FEATURE (1)..(1): N-terminal acetylation
  MISC_FEATURE (20)..(20): C-terminal amidation
YTVEVGWPTVHTGRDNYMWM

SEQ ID NO: 2136 - protein, 20 aa, Artificial Sequence
  Synthetic peptide
  MISC_FEATURE (1)..(1): N-terminal acetylation
  MISC_FEATURE (20)..(20): C-terminal amidation
YTVEVGWHPVHTGRDNYMWM

SEQ ID NO: 2137 - protein, 20 aa, Artificial Sequence
  Synthetic peptide
  MISC_FEATURE (1)..(1): N-terminal acetylation
  MISC_FEATURE (20)..(20): C-terminal amidation
YTVEVGWHTPHTGRDNYMWM

SEQ ID NO: 2138 - protein, 20 aa, Artificial Sequence
  Synthetic peptide
  MISC_FEATURE (1)..(1): N-terminal acetylation
  MISC_FEATURE (20)..(20): C-terminal amidation
YTVEVGWHTVPTGRDNYMWM

SEQ ID NO: 2139 - protein, 20 aa, Artificial Sequence
  Synthetic peptide
  MISC_FEATURE (1)..(1): N-terminal acetylation
  MISC_FEATURE (20)..(20): C-terminal amidation
YTVEVGWHTVHPGRDNYMWM

SEQ ID NO: 2140 - protein, 20 aa, Artificial Sequence
  Synthetic peptide
  MISC_FEATURE (1)..(1): N-terminal acetylation
  MISC_FEATURE (20)..(20): C-terminal amidation
YTVEVGWHTVHTPRDNYMWM

SEQ ID NO: 2141 - protein, 20 aa, Artificial Sequence
  Synthetic peptide
  MISC_FEATURE (1)..(1): N-terminal acetylation
  MISC_FEATURE (20)..(20): C-terminal amidation
YTVEVGWHTVHTGPDNYMWM

SEQ ID NO: 2142 - protein, 20 aa, Artificial Sequence
  Synthetic peptide
  MISC_FEATURE (1)..(1): N-terminal acetylation
  MISC_FEATURE (20)..(20): C-terminal amidation
YTVEVGWHTVHTGRPNYMWM

SEQ ID NO: 2143 - protein, 20 aa, Artificial Sequence
  Synthetic peptide
  MISC_FEATURE (1)..(1): N-terminal acetylation
  MISC_FEATURE (20)..(20): C-terminal amidation
YTVEVGWHTVHTGRDPYMWM

SEQ ID NO: 2144 - protein, 20 aa, Artificial Sequence
  Synthetic peptide
  MISC_FEATURE (1)..(1): N-terminal acetylation
  MISC_FEATURE (20)..(20): C-terminal amidation
YTVEVGWHTVHTGRDNPMWM

SEQ ID NO: 2145 - protein, 20 aa, Artificial Sequence
  Synthetic peptide
  MISC_FEATURE (1)..(1): N-terminal acetylation
  MISC_FEATURE (20)..(20): C-terminal amidation
YTVEVGWHTVHTGRDNYPWM

SEQ ID NO: 2146 - protein, 20 aa, Artificial Sequence
  Synthetic peptide
  MISC_FEATURE (1)..(1): N-terminal acetylation
  MISC_FEATURE (20)..(20): C-terminal amidation
YTVEVGWHTVHTGRDNYMPM

SEQ ID NO: 2147 - protein, 20 aa, Artificial Sequence
  Synthetic peptide
  MISC_FEATURE (1)..(1): N-terminal acetylation
  MISC_FEATURE (20)..(20): C-terminal amidation
YTVEVGWHTVHTGRDNYMWP

SEQ ID NO: 2148 - protein, 20 aa, Artificial Sequence
  Synthetic peptide
  MISC_FEATURE (1)..(1): N-terminal acetylation
  MISC_FEATURE (20)..(20): C-terminal amidation
STVEVGWHTVHTGRDNYMWM

SEQ ID NO: 2149 - protein, 20 aa, Artificial Sequence
  Synthetic peptide
  MISC_FEATURE (1)..(1): N-terminal acetylation
  MISC_FEATURE (20)..(20): C-terminal amidation
YSVEVGWHTVHTGRDNYMWM

SEQ ID NO: 2150 - protein, 20 aa, Artificial Sequence
  Synthetic peptide
  MISC_FEATURE (1)..(1): N-terminal acetylation
  MISC_FEATURE (20)..(20): C-terminal amidation
YTSEVGWHTVHTGRDNYMWM

SEQ ID NO: 2151 - protein, 20 aa, Artificial Sequence
  Synthetic peptide
  MISC_FEATURE (1)..(1): N-terminal acetylation
  MISC_FEATURE (20)..(20): C-terminal amidation
YTVSVGWHTVHTGRDNYMWM

SEQ ID NO: 2152 - protein, 20 aa, Artificial Sequence
  Synthetic peptide
  MISC_FEATURE (1)..(1): N-terminal acetylation
  MISC_FEATURE (20)..(20): C-terminal amidation
YTVESGWHTVHTGRDNYMWM

SEQ ID NO: 2153 - protein, 20 aa, Artificial Sequence
  Synthetic peptide
  MISC_FEATURE (1)..(1): N-terminal acetylation
  MISC_FEATURE (20)..(20): C-terminal amidation
YTVEVSWHTVHTGRDNYMWM

SEQ ID NO: 2154 - protein, 20 aa, Artificial Sequence
  Synthetic peptide
  MISC_FEATURE (1)..(1): N-terminal acetylation
  MISC_FEATURE (20)..(20): C-terminal amidation
YTVEVGSHTVHTGRDNYMWM

SEQ ID NO: 2155 - protein, 20 aa, Artificial Sequence
  Synthetic peptide
  MISC_FEATURE (1)..(1): N-terminal acetylation
  MISC_FEATURE (20)..(20): C-terminal amidation
YTVEVGWSTVHTGRDNYMWM

SEQ ID NO: 2156 - protein, 20 aa, Artificial Sequence
  Synthetic peptide
  MISC_FEATURE (1)..(1): N-terminal acetylation
  MISC_FEATURE (20)..(20): C-terminal amidation
YTVEVGWHSVHTGRDNYMWM

SEQ ID NO: 2157 - protein, 20 aa, Artificial Sequence
  Synthetic peptide
  MISC_FEATURE (1)..(1): N-terminal acetylation
  MISC_FEATURE (20)..(20): C-terminal amidation
YTVEVGWHTSHTGRDNYMWM

SEQ ID NO: 2158 - protein, 20 aa, Artificial Sequence
  Synthetic peptide
  MISC_FEATURE (1)..(1): N-terminal acetylation
  MISC_FEATURE (20)..(20): C-terminal amidation
YTVEVGWHTVSTGRDNYMWM

SEQ ID NO: 2159 - protein, 20 aa, Artificial Sequence
  Synthetic peptide
  MISC_FEATURE (1)..(1): N-terminal acetylation
  MISC_FEATURE (20)..(20): C-terminal amidation
YTVEVGWHTVHSGRDNYMWM

SEQ ID NO: 2160 - protein, 20 aa, Artificial Sequence
  Synthetic peptide
  MISC_FEATURE (1)..(1): N-terminal acetylation
  MISC_FEATURE (20)..(20): C-terminal amidation
YTVEVGWHTVHTSRDNYMWM

SEQ ID NO: 2161 - protein, 20 aa, Artificial Sequence
  Synthetic peptide
  MISC_FEATURE (1)..(1): N-terminal acetylation
  MISC_FEATURE (20)..(20): C-terminal amidation
YTVEVGWHTVHTGSDNYMWM

SEQ ID NO: 2162 - protein, 20 aa, Artificial Sequence
  Synthetic peptide
  MISC_FEATURE (1)..(1): N-terminal acetylation
  MISC_FEATURE (20)..(20): C-terminal amidation
YTVEVGWHTVHTGRSNYMWM

SEQ ID NO: 2163 - protein, 20 aa, Artificial Sequence
  Synthetic peptide
  MISC_FEATURE (1)..(1): N-terminal acetylation
  MISC_FEATURE (20)..(20): C-terminal amidation
YTVEVGWHTVHTGRDSYMWM

SEQ ID NO: 2164 - protein, 20 aa, Artificial Sequence
  Synthetic peptide
  MISC_FEATURE (1)..(1): N-terminal acetylation
  MISC_FEATURE (20)..(20): C-terminal amidation
YTVEVGWHTVHTGRDNSMWM

SEQ ID NO: 2165 - protein, 20 aa, Artificial Sequence
  Synthetic peptide
  MISC_FEATURE (1)..(1): N-terminal acetylation
  MISC_FEATURE (20)..(20): C-terminal amidation
YTVEVGWHTVHTGRDNYSWM

SEQ ID NO: 2166 - protein, 20 aa, Artificial Sequence
  Synthetic peptide
  MISC_FEATURE (1)..(1): N-terminal acetylation
  MISC_FEATURE (20)..(20): C-terminal amidation
YTVEVGWHTVHTGRDNYMSM

SEQ ID NO: 2167 - protein, 20 aa, Artificial Sequence
  Synthetic peptide
  MISC_FEATURE (1)..(1): N-terminal acetylation
  MISC_FEATURE (20)..(20): C-terminal amidation
YTVEVGWHTVHTGRDNYMWS

SEQ ID NO: 2168 - protein, 17 aa, Artificial Sequence
  Synthetic peptide
  MISC_FEATURE (1)..(1): N-terminal acetylation
  MISC_FEATURE (17)..(17): C-terminal amidation
YTVEVGWHTVHTGRDNY

SEQ ID NO: 2169 - protein, 14 aa, Artificial Sequence
  Synthetic peptide
  MISC_FEATURE (1)..(1): N-terminal acetylation
  MISC_FEATURE (14)..(14): C-terminal amidation
YTVEVGWHTVHTGR

SEQ ID NO: 2170 - protein, 11 aa, Artificial Sequence
  Synthetic peptide
  MISC_FEATURE (1)..(1): N-terminal acetylation
  MISC_FEATURE (11)..(11): C-terminal amidation
YTVEVGWHTVH

SEQ ID NO: 2171 - protein, 17 aa, Artificial Sequence
  Synthetic peptide
  MISC_FEATURE (1)..(1): N-terminal acetylation
  MISC_FEATURE (17)..(17): C-terminal amidation
EVGWHTVHTGRDNYMWM

SEQ ID NO: 2172 - protein, 14 aa, Artificial Sequence
  Synthetic peptide
  MISC_FEATURE (1)..(1): N-terminal acetylation
  MISC_FEATURE (14)..(14): C-terminal amidation
WHTVHTGRDNYMWM

SEQ ID NO: 2173 - protein, 11 aa, Artificial Sequence
  Synthetic peptide
  MISC_FEATURE (1)..(1): N-terminal acetylation
  MISC_FEATURE (11)..(11): C-terminal amidation
VHTGRDNYMWM

SEQ ID NO: 2174 - protein, 14 aa, Artificial Sequence
  Synthetic peptide
  MISC_FEATURE (1)..(1): N-terminal acetylation
  MISC_FEATURE (14)..(14): C-terminal amidation
EVGWHTVHTGRDNY

SEQ ID NO: 2175 - protein, 20 aa, Artificial Sequence
  Synthetic peptide
  MISC_FEATURE (1)..(1): N-terminal acetylation
  MISC_FEATURE (20)..(20): C-terminal amidation
AVQIGWYSVDSDRHYAYSSY

SEQ ID NO: 2176 - protein, 20 aa, Artificial Sequence
  Synthetic peptide
  MISC_FEATURE (1)..(1): N-terminal acetylation
  MISC_FEATURE (20)..(20): C-terminal amidation
HAQIGWYSVDSDRHYAYSSY

SEQ ID NO: 2177 - protein, 20 aa, Artificial Sequence
  Synthetic peptide
  MISC_FEATURE (1)..(1): N-terminal acetylation
  MISC_FEATURE (20)..(20): C-terminal amidation
HVAIGWYSVDSDRHYAYSSY

SEQ ID NO: 2178 - protein, 20 aa, Artificial Sequence
  Synthetic peptide
  MISC_FEATURE (1)..(1): N-terminal acetylation
  MISC_FEATURE (20)..(20): C-terminal amidation
HVQAGWYSVDSDRHYAYSSY

SEQ ID NO: 2179 - protein, 20 aa, Artificial Sequence
  Synthetic peptide
  MISC_FEATURE (1)..(1): N-terminal acetylation
  MISC_FEATURE (20)..(20): C-terminal amidation
HVQIAWYSVDSDRHYAYSSY

SEQ ID NO: 2180 - protein, 20 aa, Artificial Sequence
  Synthetic peptide
  MISC_FEATURE (1)..(1): N-terminal acetylation
  MISC_FEATURE (20)..(20): C-terminal amidation
HVQIGAYSVDSDRHYAYSSY

SEQ ID NO: 2181 - protein, 20 aa, Artificial Sequence
  Synthetic peptide
  MISC_FEATURE (1)..(1): N-terminal acetylation
  MISC_FEATURE (20)..(20): C-terminal amidation
HVQIGWASVDSDRHYAYSSY

SEQ ID NO: 2182 - protein, 20 aa, Artificial Sequence
  Synthetic peptide
  MISC_FEATURE (1)..(1): N-terminal acetylation
  MISC_FEATURE (20)..(20): C-terminal amidation
HVQIGWYAVDSDRHYAYSSY

SEQ ID NO: 2183 - protein, 20 aa, Artificial Sequence
  Synthetic peptide
  MISC_FEATURE (1)..(1): N-terminal acetylation
  MISC_FEATURE (20)..(20): C-terminal amidation
HVQIGWYSADSDRHYAYSSY

SEQ ID NO: 2184 - protein, 20 aa, Artificial Sequence
  Synthetic peptide
  MISC_FEATURE (1)..(1): N-terminal acetylation
  MISC_FEATURE (20)..(20): C-terminal amidation
HVQIGWYSVASDRHYAYSSY

SEQ ID NO: 2185 - protein, 20 aa, Artificial Sequence
  Synthetic peptide
  MISC_FEATURE (1)..(1): N-terminal acetylation
  MISC_FEATURE (20)..(20): C-terminal amidation
HVQIGWYSVDADRHYAYSSY

SEQ ID NO: 2186 - protein, 20 aa, Artificial Sequence
  Synthetic peptide
  MISC_FEATURE (1)..(1): N-terminal acetylation
  MISC_FEATURE (20)..(20): C-terminal amidation
HVQIGWYSVDSARHYAYSSY

SEQ ID NO: 2187 - protein, 20 aa, Artificial Sequence
  Synthetic peptide
  MISC_FEATURE (1)..(1): N-terminal acetylation
  MISC_FEATURE (20)..(20): C-terminal amidation
HVQIGWYSVDSDAHYAYSSY

SEQ ID NO: 2188 - protein, 20 aa, Artificial Sequence
  Synthetic peptide
  MISC_FEATURE (1)..(1): N-terminal acetylation
  MISC_FEATURE (20)..(20): C-terminal amidation
HVQIGWYSVDSDRAYAYSSY

SEQ ID NO: 2189 - protein, 20 aa, Artificial Sequence
  Synthetic peptide
  MISC_FEATURE (1)..(1): N-terminal acetylation
  MISC_FEATURE (20)..(20): C-terminal amidation
HVQIGWYSVDSDRHAAYSSY

SEQ ID NO: 2190 - protein, 20 aa, Artificial Sequence
  Synthetic peptide
  MISC_FEATURE (1)..(1): N-terminal acetylation
  MISC_FEATURE (20)..(20): C-terminal amidation
HVQIGWYSVDSDRHYAASSY

SEQ ID NO: 2191 - protein, 20 aa, Artificial Sequence
  Synthetic peptide
  MISC_FEATURE (1)..(1): N-terminal acetylation
  MISC_FEATURE (20)..(20): C-terminal amidation
HVQIGWYSVDSDRHYAYASY

SEQ ID NO: 2192 - protein, 20 aa, Artificial Sequence
  Synthetic peptide
  MISC_FEATURE (1)..(1): N-terminal acetylation
  MISC_FEATURE (20)..(20): C-terminal amidation
HVQIGWYSVDSDRHYAYSAY

SEQ ID NO: 2193 - protein, 20 aa, Artificial Sequence
  Synthetic peptide
  MISC_FEATURE (1)..(1): N-terminal acetylation
  MISC_FEATURE (20)..(20): C-terminal amidation
HVQIGWYSVDSDRHYAYSSA

SEQ ID NO: 2194 - protein, 20 aa, Artificial Sequence
  Synthetic peptide
  MISC_FEATURE (1)..(1): N-terminal acetylation
  MISC_FEATURE (20)..(20): C-terminal amidation
DVQIGWYSVDSDRHYAYSSY

SEQ ID NO: 2195 - protein, 20 aa, Artificial Sequence
  Synthetic peptide
  MISC_FEATURE (1)..(1): N-terminal acetylation
  MISC_FEATURE (20)..(20): C-terminal amidation
HDQIGWYSVDSDRHYAYSSY

SEQ ID NO: 2196 - protein, 20 aa, Artificial Sequence
  Synthetic peptide
  MISC_FEATURE (1)..(1): N-terminal acetylation
  MISC_FEATURE (20)..(20): C-terminal amidation
HVDIGWYSVDSDRHYAYSSY

SEQ ID NO: 2197 - protein, 20 aa, Artificial Sequence
  Synthetic peptide
  MISC_FEATURE (1)..(1): N-terminal acetylation
  MISC_FEATURE (20)..(20): C-terminal amidation
HVQDGWYSVDSDRHYAYSSY

SEQ ID NO: 2198 - protein, 20 aa, Artificial Sequence
  Synthetic peptide
  MISC_FEATURE (1)..(1): N-terminal acetylation
  MISC_FEATURE (20)..(20): C-terminal amidation
HVQIDWYSVDSDRHYAYSSY

SEQ ID NO: 2199 - protein, 20 aa, Artificial Sequence
  Synthetic peptide
  MISC_FEATURE (1)..(1): N-terminal acetylation
  MISC_FEATURE (20)..(20): C-terminal amidation
HVQIGDYSVDSDRHYAYSSY

SEQ ID NO: 2200 - protein, 20 aa, Artificial Sequence
  Synthetic peptide
  MISC_FEATURE (1)..(1): N-terminal acetylation
  MISC_FEATURE (20)..(20): C-terminal amidation
HVQIGWDSVDSDRHYAYSSY

SEQ ID NO: 2201 - protein, 20 aa, Artificial Sequence
  Synthetic peptide
  MISC_FEATURE (1)..(1): N-terminal acetylation
  MISC_FEATURE (20)..(20): C-terminal amidation
HVQIGWYDVDSDRHYAYSSY

SEQ ID NO: 2202 - protein, 20 aa, Artificial Sequence
  Synthetic peptide
  MISC_FEATURE (1)..(1): N-terminal acetylation
  MISC_FEATURE (20)..(20): C-terminal amidation
HVQIGWYSDDSDRHYAYSSY

SEQ ID NO: 2203 - protein, 20 aa, Artificial Sequence
  Synthetic peptide
  MISC_FEATURE (1)..(1): N-terminal acetylation
  MISC_FEATURE (20)..(20): C-terminal amidation
HVQIGWYSVDDDRHYAYSSY

SEQ ID NO: 2204 - protein, 20 aa, Artificial Sequence
  Synthetic peptide
  MISC_FEATURE (1)..(1): N-terminal acetylation
  MISC_FEATURE (20)..(20): C-terminal amidation
HVQIGWYSVDSDDHYAYSSY

SEQ ID NO: 2205 - protein, 20 aa, Artificial Sequence
  Synthetic peptide
  MISC_FEATURE (1)..(1): N-terminal acetylation
  MISC_FEATURE (20)..(20): C-terminal amidation
HVQIGWYSVDSDRDYAYSSY

SEQ ID NO: 2206 - protein, 20 aa, Artificial Sequence
  Synthetic peptide
  MISC_FEATURE (1)..(1): N-terminal acetylation
  MISC_FEATURE (20)..(20): C-terminal amidation
HVQIGWYSVDSDRHDAYSSY

SEQ ID NO: 2207 - protein, 20 aa, Artificial Sequence
  Synthetic peptide
  MISC_FEATURE (1)..(1): N-terminal acetylation
  MISC_FEATURE (20)..(20): C-terminal amidation
HVQIGWYSVDSDRHYDYSSY

SEQ ID NO: 2208 - protein, 20 aa, Artificial Sequence
  Synthetic peptide
  MISC_FEATURE (1)..(1): N-terminal acetylation
  MISC_FEATURE (20)..(20): C-terminal amidation
HVQIGWYSVDSDRHYADSSY

SEQ ID NO: 2209 - protein, 20 aa, Artificial Sequence
  Synthetic peptide
  MISC_FEATURE (1)..(1): N-terminal acetylation
  MISC_FEATURE (20)..(20): C-terminal amidation
HVQIGWYSVDSDRHYAYDSY

SEQ ID NO: 2210 - protein, 20 aa, Artificial Sequence
  Synthetic peptide
  MISC_FEATURE (1)..(1): N-terminal acetylation
  MISC_FEATURE (20)..(20): C-terminal amidation
HVQIGWYSVDSDRHYAYSDY

SEQ ID NO: 2211 - protein, 20 aa, Artificial Sequence
  Synthetic peptide
  MISC_FEATURE (1)..(1): N-terminal acetylation
  MISC_FEATURE (20)..(20): C-terminal amidation
HVQIGWYSVDSDRHYAYSSD

SEQ ID NO: 2212 - protein, 20 aa, Artificial Sequence
  Synthetic peptide
  MISC_FEATURE (1)..(1): N-terminal acetylation
  MISC_FEATURE (20)..(20): C-terminal amidation
GVQIGWYSVDSDRHYAYSSY

SEQ ID NO: 2213 - protein, 20 aa, Artificial Sequence
  Synthetic peptide
  MISC_FEATURE (1)..(1): N-terminal acetylation
  MISC_FEATURE (20)..(20): C-terminal amidation
HGQIGWYSVDSDRHYAYSSY

SEQ ID NO: 2214 - protein, 20 aa, Artificial Sequence
  Synthetic peptide
  MISC_FEATURE (1)..(1): N-terminal acetylation
  MISC_FEATURE (20)..(20): C-terminal amidation
HVGIGWYSVDSDRHYAYSSY

SEQ ID NO: 2215 - protein, 20 aa, Artificial Sequence
  Synthetic peptide
  MISC_FEATURE (1)..(1): N-terminal acetylation
  MISC_FEATURE (20)..(20): C-terminal amidation
HVQGGWYSVDSDRHYAYSSY

SEQ ID NO: 2216 - protein, 20 aa, Artificial Sequence
  Synthetic peptide
  MISC_FEATURE (1)..(1): N-terminal acetylation
  MISC_FEATURE (20)..(20): C-terminal amidation
HVQIGGYSVDSDRHYAYSSY

SEQ ID NO: 2217 - protein, 20 aa, Artificial Sequence
  Synthetic peptide
  MISC_FEATURE (1)..(1): N-terminal acetylation
  MISC_FEATURE (20)..(20): C-terminal amidation
HVQIGWGSVDSDRHYAYSSY

SEQ ID NO: 2218 - protein, 20 aa, Artificial Sequence
  Synthetic peptide
  MISC_FEATURE (1)..(1): N-terminal acetylation
  MISC_FEATURE (20)..(20): C-terminal amidation
HVQIGWYGVDSDRHYAYSSY

SEQ ID NO: 2219 - protein, 20 aa, Artificial Sequence
  Synthetic peptide
  MISC_FEATURE (1)..(1): N-terminal acetylation
  MISC_FEATURE (20)..(20): C-terminal amidation
HVQIGWYSGDSDRHYAYSSY

SEQ ID NO: 2220 - protein, 20 aa, Artificial Sequence
  Synthetic peptide
  MISC_FEATURE (1)..(1): N-terminal acetylation
  MISC_FEATURE (20)..(20): C-terminal amidation
HVQIGWYSVGSDRHYAYSSY

SEQ ID NO: 2221 - protein, 20 aa, Artificial Sequence
  Synthetic peptide
  MISC_FEATURE (1)..(1): N-terminal acetylation
  MISC_FEATURE (20)..(20): C-terminal amidation
HVQIGWYSVDGDRHYAYSSY

SEQ ID NO: 2222 - protein, 20 aa, Artificial Sequence
  Synthetic peptide
  MISC_FEATURE (1)..(1): N-terminal acetylation
  MISC_FEATURE (20)..(20): C-terminal amidation
HVQIGWYSVDSGRHYAYSSY

SEQ ID NO: 2223 - protein, 20 aa, Artificial Sequence
  Synthetic peptide
  MISC_FEATURE (1)..(1): N-terminal acetylation
  MISC_FEATURE (20)..(20): C-terminal amidation
HVQIGWYSVDSDGHYAYSSY

SEQ ID NO: 2224 - protein, 20 aa, Artificial Sequence
  Synthetic peptide
  MISC_FEATURE (1)..(1): N-terminal acetylation
  MISC_FEATURE (20)..(20): C-terminal amidation
HVQIGWYSVDSDRGYAYSSY

SEQ ID NO: 2225 - protein, 20 aa, Artificial Sequence
  Synthetic peptide
  MISC_FEATURE (1)..(1): N-terminal acetylation
  MISC_FEATURE (20)..(20): C-terminal amidation
HVQIGWYSVDSDRHGAYSSY

SEQ ID NO: 2226 - protein, 20 aa, Artificial Sequence
  Synthetic peptide
  MISC_FEATURE (1)..(1): N-terminal acetylation
  MISC_FEATURE (20)..(20): C-terminal amidation
HVQIGWYSVDSDRHYGYSSY

SEQ ID NO: 2227 - protein, 20 aa, Artificial Sequence
  Synthetic peptide
  MISC_FEATURE (1)..(1): N-terminal acetylation
  MISC_FEATURE (20)..(20): C-terminal amidation
HVQIGWYSVDSDRHYAGSSY

SEQ ID NO: 2228 - protein, 20 aa, Artificial Sequence
  Synthetic peptide
  MISC_FEATURE (1)..(1): N-terminal acetylation
  MISC_FEATURE (20)..(20): C-terminal amidation
HVQIGWYSVDSDRHYAYGSY

SEQ ID NO: 2229 - protein, 20 aa, Artificial Sequence
  Synthetic peptide
  MISC_FEATURE (1)..(1): N-terminal acetylation
  MISC_FEATURE (20)..(20): C-terminal amidation
HVQIGWYSVDSDRHYAYSGY

SEQ ID NO: 2230 - protein, 20 aa, Artificial Sequence
  Synthetic peptide
  MISC_FEATURE (1)..(1): N-terminal acetylation
  MISC_FEATURE (20)..(20): C-terminal amidation
HVQIGWYSVDSDRHYAYSSG

SEQ ID NO: 2231 - protein, 20 aa, Artificial Sequence
  Synthetic peptide
  MISC_FEATURE (1)..(1): N-terminal acetylation
  MISC_FEATURE (20)..(20): C-terminal amidation
LVQIGWYSVDSDRHYAYSSY

SEQ ID NO: 2232 - protein, 20 aa, Artificial Sequence
  Synthetic peptide
  MISC_FEATURE (1)..(1): N-terminal acetylation
  MISC_FEATURE (20)..(20): C-terminal amidation
HLQIGWYSVDSDRHYAYSSY

SEQ ID NO: 2233 - protein, 20 aa, Artificial Sequence
  Synthetic peptide
  MISC_FEATURE (1)..(1): N-terminal acetylation
  MISC_FEATURE (20)..(20): C-terminal amidation
HVLIGWYSVDSDRHYAYSSY

SEQ ID NO: 2234 - protein, 20 aa, Artificial Sequence
  Synthetic peptide
  MISC_FEATURE (1)..(1): N-terminal acetylation
  MISC_FEATURE (20)..(20): C-terminal amidation
HVQLGWYSVDSDRHYAYSSY

SEQ ID NO: 2235 - protein, 20 aa, Artificial Sequence
  Synthetic peptide
  MISC_FEATURE (1)..(1): N-terminal acetylation
  MISC_FEATURE (20)..(20): C-terminal amidation
HVQILWYSVDSDRHYAYSSY

SEQ ID NO: 2236 - protein, 20 aa, Artificial Sequence
  Synthetic peptide
  MISC_FEATURE (1)..(1): N-terminal acetylation
  MISC_FEATURE (20)..(20): C-terminal amidation
HVQIGLYSVDSDRHYAYSSY

SEQ ID NO: 2237 - protein, 20 aa, Artificial Sequence
  Synthetic peptide
  MISC_FEATURE (1)..(1): N-terminal acetylation
  MISC_FEATURE (20)..(20): C-terminal amidation
HVQIGWLSVDSDRHYAYSSY

SEQ ID NO: 2238 - protein, 20 aa, Artificial Sequence
  Synthetic peptide
  MISC_FEATURE (1)..(1): N-terminal acetylation
  MISC_FEATURE (20)..(20): C-terminal amidation
HVQIGWYLVDSDRHYAYSSY

SEQ ID NO: 2239 - protein, 20 aa, Artificial Sequence
  Synthetic peptide
  MISC_FEATURE (1)..(1): N-terminal acetylation
  MISC_FEATURE (20)..(20): C-terminal amidation
HVQIGWYSLDSDRHYAYSSY

SEQ ID NO: 2240 - protein, 20 aa, Artificial Sequence
  Synthetic peptide
  MISC_FEATURE (1)..(1): N-terminal acetylation
  MISC_FEATURE (20)..(20): C-terminal amidation
HVQIGWYSVLSDRHYAYSSY

SEQ ID NO: 2241 - protein, 20 aa, Artificial Sequence
  Synthetic peptide
  MISC_FEATURE (1)..(1): N-terminal acetylation
  MISC_FEATURE (20)..(20): C-terminal amidation
HVQIGWYSVDLDRHYAYSSY

SEQ ID NO: 2242 - protein, 20 aa, Artificial Sequence
  Synthetic peptide
  MISC_FEATURE (1)..(1): N-terminal acetylation
  MISC_FEATURE (20)..(20): C-terminal amidation
HVQIGWYSVDSLRHYAYSSY

SEQ ID NO: 2243 - protein, 20 aa, Artificial Sequence
  Synthetic peptide
  MISC_FEATURE (1)..(1): N-terminal acetylation
  MISC_FEATURE (20)..(20): C-terminal amidation
HVQIGWYSVDSDLHYAYSSY

SEQ ID NO: 2244 - protein, 20 aa, Artificial Sequence
  Synthetic peptide
  MISC_FEATURE (1)..(1): N-terminal acetylation
  MISC_FEATURE (20)..(20): C-terminal amidation
HVQIGWYSVDSDRLYAYSSY

SEQ ID NO: 2245 - protein, 20 aa, Artificial Sequence
  Synthetic peptide
  MISC_FEATURE (1)..(1): N-terminal acetylation
  MISC_FEATURE (20)..(20): C-terminal amidation
HVQIGWYSVDSDRHLAYSSY

SEQ ID NO: 2246 - protein, 20 aa, Artificial Sequence
  Synthetic peptide
  MISC_FEATURE (1)..(1): N-terminal acetylation
  MISC_FEATURE (20)..(20): C-terminal amidation
HVQIGWYSVDSDRHYLYSSY

SEQ ID NO: 2247 - protein, 20 aa, Artificial Sequence
  Synthetic peptide
  MISC_FEATURE (1)..(1): N-terminal acetylation
  MISC_FEATURE (20)..(20): C-terminal amidation
HVQIGWYSVDSDRHYALSSY

SEQ ID NO: 2248 - protein, 20 aa, Artificial Sequence
  Synthetic peptide
  MISC_FEATURE (1)..(1): N-terminal acetylation
  MISC_FEATURE (20)..(20): C-terminal amidation
HVQIGWYSVDSDRHYAYLSY

SEQ ID NO: 2249 - protein, 20 aa, Artificial Sequence
  Synthetic peptide
  MISC_FEATURE (1)..(1): N-terminal acetylation
  MISC_FEATURE (20)..(20): C-terminal amidation
HVQIGWYSVDSDRHYAYSLY

SEQ ID NO: 2250 - protein, 20 aa, Artificial Sequence
  Synthetic peptide
  MISC_FEATURE (1)..(1): N-terminal acetylation
  MISC_FEATURE (20)..(20): C-terminal amidation
HVQIGWYSVDSDRHYAYSSL

SEQ ID NO: 2251 - protein, 20 aa, Artificial Sequence
  Synthetic peptide
  MISC_FEATURE (1)..(1): N-terminal acetylation
  MISC_FEATURE (20)..(20): C-terminal amidation
KVQIGWYSVDSDRHYAYSSY

SEQ ID NO: 2252 - protein, 20 aa, Artificial Sequence
  Synthetic peptide
  MISC_FEATURE (1)..(1): N-terminal acetylation
  MISC_FEATURE (20)..(20): C-terminal amidation
HKQIGWYSVDSDRHYAYSSY

SEQ ID NO: 2253 - protein, 20 aa, Artificial Sequence
  Synthetic peptide
  MISC_FEATURE (1)..(1): N-terminal acetylation
  MISC_FEATURE (20)..(20): C-terminal amidation
HVKIGWYSVDSDRHYAYSSY

SEQ ID NO: 2254 - protein, 20 aa, Artificial Sequence
  Synthetic peptide
  MISC_FEATURE (1)..(1): N-terminal acetylation
  MISC_FEATURE (20)..(20): C-terminal amidation
HVQKGWYSVDSDRHYAYSSY

SEQ ID NO: 2255 - protein, 20 aa, Artificial Sequence
  Synthetic peptide
  MISC_FEATURE (1)..(1): N-terminal acetylation
  MISC_FEATURE (20)..(20): C-terminal amidation
HVQIKWYSVDSDRHYAYSSY

SEQ ID NO: 2256 - protein, 20 aa, Artificial Sequence
  Synthetic peptide
  MISC_FEATURE (1)..(1): N-terminal acetylation
  MISC_FEATURE (20)..(20): C-terminal amidation
HVQIGKYSVDSDRHYAYSSY

SEQ ID NO: 2257 - protein, 20 aa, Artificial Sequence
  Synthetic peptide
  MISC_FEATURE (1)..(1): N-terminal acetylation
  MISC_FEATURE (20)..(20): C-terminal amidation
HVQIGWKSVDSDRHYAYSSY

SEQ ID NO: 2258 - protein, 20 aa, Artificial Sequence
  Synthetic peptide
  MISC_FEATURE (1)..(1): N-terminal acetylation
  MISC_FEATURE (20)..(20): C-terminal amidation
HVQIGWYKVDSDRHYAYSSY

SEQ ID NO: 2259 - protein, 20 aa, Artificial Sequence
  Synthetic peptide
  MISC_FEATURE (1)..(1): N-terminal acetylation
  MISC_FEATURE (20)..(20): C-terminal amidation
HVQIGWYSKDSDRHYAYSSY

SEQ ID NO: 2260 - protein, 20 aa, Artificial Sequence
  Synthetic peptide
  MISC_FEATURE (1)..(1): N-terminal acetylation
  MISC_FEATURE (20)..(20): C-terminal amidation
HVQIGWYSVKSDRHYAYSSY

SEQ ID NO: 2261 - protein, 20 aa, Artificial Sequence
  Synthetic peptide
  MISC_FEATURE (1)..(1): N-terminal acetylation
  MISC_FEATURE (20)..(20): C-terminal amidation
HVQIGWYSVDKDRHYAYSSY

SEQ ID NO: 2262 - protein, 20 aa, Artificial Sequence
  Synthetic peptide
  MISC_FEATURE (1)..(1): N-terminal acetylation
  MISC_FEATURE (20)..(20): C-terminal amidation
HVQIGWYSVDSKRHYAYSSY

SEQ ID NO: 2263 - protein, 20 aa, Artificial Sequence
  Synthetic peptide
  MISC_FEATURE (1)..(1): N-terminal acetylation
  MISC_FEATURE (20)..(20): C-terminal amidation
HVQIGWYSVDSDKHYAYSSY

SEQ ID NO: 2264 - protein, 20 aa, Artificial Sequence
  Synthetic peptide
  MISC_FEATURE (1)..(1): N-terminal acetylation
  MISC_FEATURE (20)..(20): C-terminal amidation
HVQIGWYSVDSDRKYAYSSY

SEQ ID NO: 2265 - protein, 20 aa, Artificial Sequence
  Synthetic peptide
  MISC_FEATURE (1)..(1): N-terminal acetylation
  MISC_FEATURE (20)..(20): C-terminal amidation
HVQIGWYSVDSDRHKAYSSY

SEQ ID NO: 2266 - protein, 20 aa, Artificial Sequence
  Synthetic peptide
  MISC_FEATURE (1)..(1): N-terminal acetylation
  MISC_FEATURE (20)..(20): C-terminal amidation
HVQIGWYSVDSDRHYKYSSY

SEQ ID NO: 2267 - protein, 20 aa, Artificial Sequence
  Synthetic peptide
  MISC_FEATURE (1)..(1): N-terminal acetylation
  MISC_FEATURE (20)..(20): C-terminal amidation
HVQIGWYSVDSDRHYAKSSY

SEQ ID NO: 2268 - protein, 20 aa, Artificial Sequence
  Synthetic peptide
  MISC_FEATURE (1)..(1): N-terminal acetylation
  MISC_FEATURE (20)..(20): C-terminal amidation
HVQIGWYSVDSDRHYAYKSY

SEQ ID NO: 2269 - protein, 20 aa, Artificial Sequence
  Synthetic peptide
  MISC_FEATURE (1)..(1): N-terminal acetylation
  MISC_FEATURE (20)..(20): C-terminal amidation
HVQIGWYSVDSDRHYAYSKY

SEQ ID NO: 2270 - protein, 20 aa, Artificial Sequence
  Synthetic peptide
  MISC_FEATURE (1)..(1): N-terminal acetylation
  MISC_FEATURE (20)..(20): C-terminal amidation
HVQIGWYSVDSDRHYAYSSK

SEQ ID NO: 2271 - protein, 20 aa, Artificial Sequence
  Synthetic peptide
  MISC_FEATURE (1)..(1): N-terminal acetylation
  MISC_FEATURE (20)..(20): C-terminal amidation
FVQIGWYSVDSDRHYAYSSY

SEQ ID NO: 2272 - protein, 20 aa, Artificial Sequence
  Synthetic peptide
  MISC_FEATURE (1)..(1): N-terminal acetylation
  MISC_FEATURE (20)..(20): C-terminal amidation
HFQIGWYSVDSDRHYAYSSY

SEQ ID NO: 2273 - protein, 20 aa, Artificial Sequence
  Synthetic peptide
  MISC_FEATURE (1)..(1): N-terminal acetylation
  MISC_FEATURE (20)..(20): C-terminal amidation
HVFIGWYSVDSDRHYAYSSY

SEQ ID NO: 2274 - protein, 20 aa, Artificial Sequence
  Synthetic peptide
  MISC_FEATURE (1)..(1): N-terminal acetylation
  MISC_FEATURE (20)..(20): C-terminal amidation
HVQFGWYSVDSDRHYAYSSY

SEQ ID NO: 2275 - protein, 20 aa, Artificial Sequence
  Synthetic peptide
  MISC_FEATURE (1)..(1): N-terminal acetylation
  MISC_FEATURE (20)..(20): C-terminal amidation
HVQIFWYSVDSDRHYAYSSY

SEQ ID NO: 2276 - protein, 20 aa, Artificial Sequence
  Synthetic peptide
  MISC_FEATURE (1)..(1): N-terminal acetylation
  MISC_FEATURE (20)..(20): C-terminal amidation
HVQIGFYSVDSDRHYAYSSY

SEQ ID NO: 2277 - protein, 20 aa, Artificial Sequence
  Synthetic peptide
  MISC_FEATURE (1)..(1): N-terminal acetylation
  MISC_FEATURE (20)..(20): C-terminal amidation
HVQIGWFSVDSDRHYAYSSY

SEQ ID NO: 2278 - protein, 20 aa, Artificial Sequence
  Synthetic peptide
  MISC_FEATURE (1)..(1): N-terminal acetylation
  MISC_FEATURE (20)..(20): C-terminal amidation
HVQIGWYFVDSDRHYAYSSY

SEQ ID NO: 2279 - protein, 20 aa, Artificial Sequence
  Synthetic peptide
  MISC_FEATURE (1)..(1): N-terminal acetylation
  MISC_FEATURE (20)..(20): C-terminal amidation
HVQIGWYSFDSDRHYAYSSY

SEQ ID NO: 2280 - protein, 20 aa, Artificial Sequence
  Synthetic peptide
  MISC_FEATURE (1)..(1): N-terminal acetylation
  MISC_FEATURE (20)..(20): C-terminal amidation
HVQIGWYSVFSDRHYAYSSY

SEQ ID NO: 2281 - protein, 20 aa, Artificial Sequence
  Synthetic peptide
  MISC_FEATURE (1)..(1): N-terminal acetylation
  MISC_FEATURE (20)..(20): C-terminal amidation
HVQIGWYSVDFDRHYAYSSY

SEQ ID NO: 2282 - protein, 20 aa, Artificial Sequence
  Synthetic peptide
  MISC_FEATURE (1)..(1): N-terminal acetylation
  MISC_FEATURE (20)..(20): C-terminal amidation
HVQIGWYSVDSFRHYAYSSY

SEQ ID NO: 2283 - protein, 20 aa, Artificial Sequence
  Synthetic peptide
  MISC_FEATURE (1)..(1): N-terminal acetylation
  MISC_FEATURE (20)..(20): C-terminal amidation
HVQIGWYSVDSDFHYAYSSY

SEQ ID NO: 2284 - protein, 20 aa, Artificial Sequence
  Synthetic peptide
  MISC_FEATURE (1)..(1): N-terminal acetylation
  MISC_FEATURE (20)..(20): C-terminal amidation
HVQIGWYSVDSDRFYAYSSY

SEQ ID NO: 2285 - protein, 20 aa, Artificial Sequence
  Synthetic peptide
  MISC_FEATURE (1)..(1): N-terminal acetylation
  MISC_FEATURE (20)..(20): C-terminal amidation
HVQIGWYSVDSDRHFAYSSY

SEQ ID NO: 2286 - protein, 20 aa, Artificial Sequence
  Synthetic peptide
  MISC_FEATURE (1)..(1): N-terminal acetylation
  MISC_FEATURE (20)..(20): C-terminal amidation
HVQIGWYSVDSDRHYFYSSY

SEQ ID NO: 2287 - protein, 20 aa, Artificial Sequence
  Synthetic peptide
  MISC_FEATURE (1)..(1): N-terminal acetylation
  MISC_FEATURE (20)..(20): C-terminal amidation
HVQIGWYSVDSDRHYAFSSY

SEQ ID NO: 2288 - protein, 20 aa, Artificial Sequence
  Synthetic peptide
  MISC_FEATURE (1)..(1): N-terminal acetylation
  MISC_FEATURE (20)..(20): C-terminal amidation
HVQIGWYSVDSDRHYAYFSY

SEQ ID NO: 2289 - protein, 20 aa, Artificial Sequence
  Synthetic peptide
  MISC_FEATURE (1)..(1): N-terminal acetylation
  MISC_FEATURE (20)..(20): C-terminal amidation
HVQIGWYSVDSDRHYAYSFY

SEQ ID NO: 2290 - protein, 20 aa, Artificial Sequence
  Synthetic peptide
  MISC_FEATURE (1)..(1): N-terminal acetylation
  MISC_FEATURE (20)..(20): C-terminal amidation
HVQIGWYSVDSDRHYAYSSF

SEQ ID NO: 2291 - protein, 20 aa, Artificial Sequence
  Synthetic peptide
  MISC_FEATURE (1)..(1): N-terminal acetylation
  MISC_FEATURE (20)..(20): C-terminal amidation
PVQIGWYSVDSDRHYAYSSY

SEQ ID NO: 2292 - protein, 20 aa, Artificial Sequence
  Synthetic peptide
  MISC_FEATURE (1)..(1): N-terminal acetylation
  MISC_FEATURE (20)..(20): C-terminal amidation
HPQIGWYSVDSDRHYAYSSY

SEQ ID NO: 2293 - protein, 20 aa, Artificial Sequence
  Synthetic peptide
  MISC_FEATURE (1)..(1): N-terminal acetylation
  MISC_FEATURE (20)..(20): C-terminal amidation
HVPIGWYSVDSDRHYAYSSY

SEQ ID NO: 2294 - protein, 20 aa, Artificial Sequence
  Synthetic peptide
  MISC_FEATURE (1)..(1): N-terminal acetylation
  MISC_FEATURE (20)..(20): C-terminal amidation
HVQPGWYSVDSDRHYAYSSY

SEQ ID NO: 2295 - protein, 20 aa, Artificial Sequence
  Synthetic peptide
  MISC_FEATURE (1)..(1): N-terminal acetylation
  MISC_FEATURE (20)..(20): C-terminal amidation
HVQIPWYSVDSDRHYAYSSY

SEQ ID NO: 2296 - protein, 20 aa, Artificial Sequence
  Synthetic peptide
  MISC_FEATURE (1)..(1): N-terminal acetylation
  MISC_FEATURE (20)..(20): C-terminal amidation
HVQIGPYSVDSDRHYAYSSY

SEQ ID NO: 2297 - protein, 20 aa, Artificial Sequence
  Synthetic peptide
  MISC_FEATURE (1)..(1): N-terminal acetylation
  MISC_FEATURE (20)..(20): C-terminal amidation
HVQIGWPSVDSDRHYAYSSY

SEQ ID NO: 2298 - protein, 20 aa, Artificial Sequence
  Synthetic peptide
  MISC_FEATURE (1)..(1): N-terminal acetylation
  MISC_FEATURE (20)..(20): C-terminal amidation
HVQIGWYPVDSDRHYAYSSY

SEQ ID NO: 2299 - protein, 20 aa, Artificial Sequence
  Synthetic peptide
  MISC_FEATURE (1)..(1): N-terminal acetylation
  MISC_FEATURE (20)..(20): C-terminal amidation
HVQIGWYSPDSDRHYAYSSY

SEQ ID NO: 2300 - protein, 20 aa, Artificial Sequence
  Synthetic peptide
  MISC_FEATURE (1)..(1): N-terminal acetylation
  MISC_FEATURE (20)..(20): C-terminal amidation
HVQIGWYSVPSDRHYAYSSY

SEQ ID NO: 2301 - protein, 20 aa, Artificial Sequence
  Synthetic peptide
  MISC_FEATURE (1)..(1): N-terminal acetylation
  MISC_FEATURE (20)..(20): C-terminal amidation
HVQIGWYSVDPDRHYAYSSY

SEQ ID NO: 2302 - protein, 20 aa, Artificial Sequence
  Synthetic peptide
  MISC_FEATURE (1)..(1): N-terminal acetylation
  MISC_FEATURE (20)..(20): C-terminal amidation
HVQIGWYSVDSPRHYAYSSY

SEQ ID NO: 2303 - protein, 20 aa, Artificial Sequence
  Synthetic peptide
  MISC_FEATURE (1)..(1): N-terminal acetylation
  MISC_FEATURE (20)..(20): C-terminal amidation
HVQIGWYSVDSDPHYAYSSY

SEQ ID NO: 2304 - protein, 20 aa, Artificial Sequence
  Synthetic peptide
  MISC_FEATURE (1)..(1): N-terminal acetylation
  MISC_FEATURE (20)..(20): C-terminal amidation
HVQIGWYSVDSDRPYAYSSY

SEQ ID NO: 2305 - protein, 20 aa, Artificial Sequence
  Synthetic peptide
  MISC_FEATURE (1)..(1): N-terminal acetylation
  MISC_FEATURE (20)..(20): C-terminal amidation
HVQIGWYSVDSDRHPAYSSY

SEQ ID NO: 2306 - protein, 20 aa, Artificial Sequence
  Synthetic peptide
  MISC_FEATURE (1)..(1): N-terminal acetylation
  MISC_FEATURE (20)..(20): C-terminal amidation
HVQIGWYSVDSDRHYPYSSY

SEQ ID NO: 2307 - protein, 20 aa, Artificial Sequence
  Synthetic peptide
  MISC_FEATURE (1)..(1): N-terminal acetylation
  MISC_FEATURE (20)..(20): C-terminal amidation
HVQIGWYSVDSDRHYAPSSY

SEQ ID NO: 2308 - protein, 20 aa, Artificial Sequence
  Synthetic peptide
  MISC_FEATURE (1)..(1): N-terminal acetylation
  MISC_FEATURE (20)..(20): C-terminal amidation
HVQIGWYSVDSDRHYAYPSY

SEQ ID NO: 2309 - protein, 20 aa, Artificial Sequence
  Synthetic peptide
  MISC_FEATURE (1)..(1): N-terminal acetylation
  MISC_FEATURE (20)..(20): C-terminal amidation
HVQIGWYSVDSDRHYAYSPY

SEQ ID NO: 2310 - protein, 20 aa, Artificial Sequence
  Synthetic peptide
  MISC_FEATURE (1)..(1): N-terminal acetylation
  MISC_FEATURE (20)..(20): C-terminal amidation
HVQIGWYSVDSDRHYAYSSP

SEQ ID NO: 2311 - protein, 20 aa, Artificial Sequence
  Synthetic peptide
  MISC_FEATURE (1)..(1): N-terminal acetylation
  MISC_FEATURE (20)..(20): C-terminal amidation
SVQIGWYSVDSDRHYAYSSY

SEQ ID NO: 2312 - protein, 20 aa, Artificial Sequence
  Synthetic peptide
  MISC_FEATURE (1)..(1): N-terminal acetylation
  MISC_FEATURE (20)..(20): C-terminal amidation
HSQIGWYSVDSDRHYAYSSY

SEQ ID NO: 2313 - protein, 20 aa, Artificial Sequence
  Synthetic peptide
  MISC_FEATURE (1)..(1): N-terminal acetylation
  MISC_FEATURE (20)..(20): C-terminal amidation
HVSIGWYSVDSDRHYAYSSY

SEQ ID NO: 2314 - protein, 20 aa, Artificial Sequence
  Synthetic peptide
  MISC_FEATURE (1)..(1): N-terminal acetylation
  MISC_FEATURE (20)..(20): C-terminal amidation
HVQSGWYSVDSDRHYAYSSY

SEQ ID NO: 2315 - protein, 20 aa, Artificial Sequence
  Synthetic peptide
  MISC_FEATURE (1)..(1): N-terminal acetylation
  MISC_FEATURE (20)..(20): C-terminal amidation
HVQISWYSVDSDRHYAYSSY

SEQ ID NO: 2316 - protein, 20 aa, Artificial Sequence
  Synthetic peptide
  MISC_FEATURE (1)..(1): N-terminal acetylation
  MISC_FEATURE (20)..(20): C-terminal amidation
HVQIGSYSVDSDRHYAYSSY

SEQ ID NO: 2317 - protein, 20 aa, Artificial Sequence
  Synthetic peptide
  MISC_FEATURE (1)..(1): N-terminal acetylation
  MISC_FEATURE (20)..(20): C-terminal amidation
HVQIGWSSVDSDRHYAYSSY

SEQ ID NO: 2318 - protein, 20 aa, Artificial Sequence
  Synthetic peptide
  MISC_FEATURE (1)..(1): N-terminal acetylation
  MISC_FEATURE (20)..(20): C-terminal amidation
HVQIGWYSSDSDRHYAYSSY

SEQ ID NO: 2319 - protein, 20 aa, Artificial Sequence
  Synthetic peptide
  MISC_FEATURE (1)..(1): N-terminal acetylation
  MISC_FEATURE (20)..(20): C-terminal amidation
HVQIGWYSVSSDRHYAYSSY

SEQ ID NO: 2320 - protein, 20 aa, Artificial Sequence
  Synthetic peptide
  MISC_FEATURE (1)..(1): N-terminal acetylation
  MISC_FEATURE (20)..(20): C-terminal amidation
HVQIGWYSVDSSRHYAYSSY

SEQ ID NO: 2321 - protein, 20 aa, Artificial Sequence
  Synthetic peptide
  MISC_FEATURE (1)..(1): N-terminal acetylation
  MISC_FEATURE (20)..(20): C-terminal amidation
HVQIGWYSVDSDSHYAYSSY

SEQ ID NO: 2322 - protein, 20 aa, Artificial Sequence
  Synthetic peptide
  MISC_FEATURE (1)..(1): N-terminal acetylation
  MISC_FEATURE (20)..(20): C-terminal amidation
HVQIGWYSVDSDRSYAYSSY

SEQ ID NO: 2323 - protein, 20 aa, Artificial Sequence
  Synthetic peptide
  MISC_FEATURE (1)..(1): N-terminal acetylation
  MISC_FEATURE (20)..(20): C-terminal amidation
HVQIGWYSVDSDRHSAYSSY

SEQ ID NO: 2324 - protein, 20 aa, Artificial Sequence
  Synthetic peptide
  MISC_FEATURE (1)..(1): N-terminal acetylation
  MISC_FEATURE (20)..(20): C-terminal amidation
HVQIGWYSVDSDRHYSYSSY

SEQ ID NO: 2325 - protein, 20 aa, Artificial Sequence
  Synthetic peptide
  MISC_FEATURE (1)..(1): N-terminal acetylation
  MISC_FEATURE (20)..(20): C-terminal amidation
HVQIGWYSVDSDRHYASSSY

SEQ ID NO: 2326 - protein, 20 aa, Artificial Sequence
  Synthetic peptide
  MISC_FEATURE (1)..(1): N-terminal acetylation
  MISC_FEATURE (20)..(20): C-terminal amidation
HVQIGWYSVDSDRHYAYSSS

SEQ ID NO: 2327 - protein, 17 aa, Artificial Sequence
  Synthetic peptide
  MISC_FEATURE (1)..(1): N-terminal acetylation
  MISC_FEATURE (17)..(17): C-terminal amidation
HVQIGWYSVDSDRHYAY

SEQ ID NO: 2328 - protein, 14 aa, Artificial Sequence
  Synthetic peptide
  MISC_FEATURE (1)..(1): N-terminal acetylation
  MISC_FEATURE (14)..(14): C-terminal amidation
HVQIGWYSVDSDRH

SEQ ID NO: 2329 - protein, 11 aa, Artificial Sequence
  Synthetic peptide
  MISC_FEATURE (1)..(1): N-terminal acetylation
  MISC_FEATURE (11)..(11): C-terminal amidation
HVQIGWYSVDS

SEQ ID NO: 2330 - protein, 17 aa, Artificial Sequence
  Synthetic peptide
  MISC_FEATURE (1)..(1): N-terminal acetylation
  MISC_FEATURE (17)..(17): C-terminal amidation
IGWYSVDSDRHYAYSSY

SEQ ID NO: 2331 - protein, 14 aa, Artificial Sequence
  Synthetic peptide
  MISC_FEATURE (1)..(1): N-terminal acetylation
  MISC_FEATURE (14)..(14): C-terminal amidation
YSVDSDRHYAYSSY

SEQ ID NO: 2332 - protein, 11 aa, Artificial Sequence
  Synthetic peptide
  MISC_FEATURE (1)..(1): N-terminal acetylation
  MISC_FEATURE (11)..(11): C-terminal amidation
DSDRHYAYSSY

SEQ ID NO: 2333 - protein, 14 aa, Artificial Sequence
  Synthetic peptide
  MISC_FEATURE (1)..(1): N-terminal acetylation
  MISC_FEATURE (14)..(14): C-terminal amidation
IGWYSVDSDRHYAY

SEQ ID NO: 2334 - protein, 20 aa, Artificial Sequence
  Synthetic peptide
  MISC_FEATURE (1)..(1): N-terminal acetylation
  MISC_FEATURE (20)..(20): C-terminal amidation
AQVWWWGPKARMGLIEYGWE

SEQ ID NO: 2335 - protein, 20 aa, Artificial Sequence
  Synthetic peptide
  MISC_FEATURE (1)..(1): N-terminal acetylation
  MISC_FEATURE (20)..(20): C-terminal amidation
DAVWWWGPKARMGLIEYGWE

SEQ ID NO: 2336 - protein, 20 aa, Artificial Sequence
  Synthetic peptide
  MISC_FEATURE (1)..(1): N-terminal acetylation
  MISC_FEATURE (20)..(20): C-terminal amidation
DQAWWWGPKARMGLIEYGWE

SEQ ID NO: 2337 - protein, 20 aa, Artificial Sequence
  Synthetic peptide
  MISC_FEATURE (1)..(1): N-terminal acetylation
  MISC_FEATURE (20)..(20): C-terminal amidation
DQVAWWGPKARMGLIEYGWE

SEQ ID NO: 2338 - protein, 20 aa, Artificial Sequence
  Synthetic peptide
  MISC_FEATURE (1)..(1): N-terminal acetylation
  MISC_FEATURE (20)..(20): C-terminal amidation
DQVWAWGPKARMGLIEYGWE

SEQ ID NO: 2339 - protein, 20 aa, Artificial Sequence
  Synthetic peptide
  MISC_FEATURE (1)..(1): N-terminal acetylation
  MISC_FEATURE (20)..(20): C-terminal amidation
DQVWWAGPKARMGLIEYGWE

SEQ ID NO: 2340 - protein, 20 aa, Artificial Sequence
  Synthetic peptide
  MISC_FEATURE (1)..(1): N-terminal acetylation
  MISC_FEATURE (20)..(20): C-terminal amidation
DQVWWWAPKARMGLIEYGWE

SEQ ID NO: 2341 - protein, 20 aa, Artificial Sequence
  Synthetic peptide
  MISC_FEATURE (1)..(1): N-terminal acetylation
  MISC_FEATURE (20)..(20): C-terminal amidation
DQVWWWGAKARMGLIEYGWE

SEQ ID NO: 2342 - protein, 20 aa, Artificial Sequence
  Synthetic peptide
  MISC_FEATURE (1)..(1): N-terminal acetylation
  MISC_FEATURE (20)..(20): C-terminal amidation
DQVWWWGPAARMGLIEYGWE

SEQ ID NO: 2343 - protein, 20 aa, Artificial Sequence
  Synthetic peptide
  MISC_FEATURE (1)..(1): N-terminal acetylation
  MISC_FEATURE (20)..(20): C-terminal amidation
DQVWWWGPKAAMGLIEYGWE

SEQ ID NO: 2344 - protein, 20 aa, Artificial Sequence
  Synthetic peptide
  MISC_FEATURE (1)..(1): N-terminal acetylation
  MISC_FEATURE (20)..(20): C-terminal amidation
DQVWWWGPKARAGLIEYGWE

SEQ ID NO: 2345 - protein, 20 aa, Artificial Sequence
  Synthetic peptide
  MISC_FEATURE (1)..(1): N-terminal acetylation
  MISC_FEATURE (20)..(20): C-terminal amidation
DQVWWWGPKARMALIEYGWE

SEQ ID NO: 2346 - protein, 20 aa, Artificial Sequence
  Synthetic peptide
  MISC_FEATURE (1)..(1): N-terminal acetylation
  MISC_FEATURE (20)..(20): C-terminal amidation
DQVWWWGPKARMGAIEYGWE

SEQ ID NO: 2347 - protein, 20 aa, Artificial Sequence
  Synthetic peptide
  MISC_FEATURE (1)..(1): N-terminal acetylation
  MISC_FEATURE (20)..(20): C-terminal amidation
DQVWWWGPKARMGLAEYGWE

SEQ ID NO: 2348 - protein, 20 aa, Artificial Sequence
  Synthetic peptide
  MISC_FEATURE (1)..(1): N-terminal acetylation
  MISC_FEATURE (20)..(20): C-terminal amidation
DQVWWWGPKARMGLIAYGWE

SEQ ID NO: 2349 - protein, 20 aa, Artificial Sequence
  Synthetic peptide
  MISC_FEATURE (1)..(1): N-terminal acetylation
  MISC_FEATURE (20)..(20): C-terminal amidation
DQVWWWGPKARMGLIEAGWE

SEQ ID NO: 2350 - protein, 20 aa, Artificial Sequence
  Synthetic peptide
  MISC_FEATURE (1)..(1): N-terminal acetylation
  MISC_FEATURE (20)..(20): C-terminal amidation
DQVWWWGPKARMGLIEYAWE

SEQ ID NO: 2351 - protein, 20 aa, Artificial Sequence
  Synthetic peptide
  MISC_FEATURE (1)..(1): N-terminal acetylation
  MISC_FEATURE (20)..(20): C-terminal amidation
DQVWWWGPKARMGLIEYGAE

SEQ ID NO: 2352 - protein, 20 aa, Artificial Sequence
  Synthetic peptide
  MISC_FEATURE (1)..(1): N-terminal acetylation
  MISC_FEATURE (20)..(20): C-terminal amidation
DQVWWWGPKARMGLIEYGWA

SEQ ID NO: 2353 - protein, 20 aa, Artificial Sequence
  Synthetic peptide
  MISC_FEATURE (1)..(1): N-terminal acetylation
  MISC_FEATURE (20)..(20): C-terminal amidation
DDVWWWGPKARMGLIEYGWE

SEQ ID NO: 2354 - protein, 20 aa, Artificial Sequence
  Synthetic peptide
  MISC_FEATURE (1)..(1): N-terminal acetylation
  MISC_FEATURE (20)..(20): C-terminal amidation
DQDWWWGPKARMGLIEYGWE

SEQ ID NO: 2355 - protein, 20 aa, Artificial Sequence
  Synthetic peptide
  MISC_FEATURE (1)..(1): N-terminal acetylation
  MISC_FEATURE (20)..(20): C-terminal amidation
DQVDWWGPKARMGLIEYGWE

SEQ ID NO: 2356 - protein, 20 aa, Artificial Sequence
  Synthetic peptide
  MISC_FEATURE (1)..(1): N-terminal acetylation
  MISC_FEATURE (20)..(20): C-terminal amidation
DQVWDWGPKARMGLIEYGWE

SEQ ID NO: 2357 - protein, 20 aa, Artificial Sequence
  Synthetic peptide
  MISC_FEATURE (1)..(1): N-terminal acetylation
  MISC_FEATURE (20)..(20): C-terminal amidation
DQVWWDGPKARMGLIEYGWE

SEQ ID NO: 2358 - protein, 20 aa, Artificial Sequence
  Synthetic peptide
  MISC_FEATURE (1)..(1): N-terminal acetylation
  MISC_FEATURE (20)..(20): C-terminal amidation
DQVWWWDPKARMGLIEYGWE

SEQ ID NO: 2359 - protein, 20 aa, Artificial Sequence
  Synthetic peptide
  MISC_FEATURE (1)..(1): N-terminal acetylation
  MISC_FEATURE (20)..(20): C-terminal amidation
DQVWWWGDKARMGLIEYGWE

SEQ ID NO: 2360 - protein, 20 aa, Artificial Sequence
  Synthetic peptide
  MISC_FEATURE (1)..(1): N-terminal acetylation
  MISC_FEATURE (20)..(20): C-terminal amidation
DQVWWWGPDARMGLIEYGWE

SEQ ID NO: 2361 - protein, 20 aa, Artificial Sequence
  Synthetic peptide
  MISC_FEATURE (1)..(1): N-terminal acetylation
  MISC_FEATURE (20)..(20): C-terminal amidation
DQVWWWGPKDRMGLIEYGWE

SEQ ID NO: 2362 - protein, 20 aa, Artificial Sequence
  Synthetic peptide
  MISC_FEATURE (1)..(1): N-terminal acetylation
  MISC_FEATURE (20)..(20): C-terminal amidation
DQVWWWGPKADMGLIEYGWE

SEQ ID NO: 2363 - protein, 20 aa, Artificial Sequence
  Synthetic peptide
  MISC_FEATURE (1)..(1): N-terminal acetylation
  MISC_FEATURE (20)..(20): C-terminal amidation
DQVWWWGPKARDGLIEYGWE

SEQ ID NO: 2364 - protein, 20 aa, Artificial Sequence
  Synthetic peptide
  MISC_FEATURE (1)..(1): N-terminal acetylation
  MISC_FEATURE (20)..(20): C-terminal amidation
DQVWWWGPKARMDLIEYGWE

SEQ ID NO: 2365 - protein, 20 aa, Artificial Sequence
  Synthetic peptide
  MISC_FEATURE (1)..(1): N-terminal acetylation
  MISC_FEATURE (20)..(20): C-terminal amidation
DQVWWWGPKARMGDIEYGWE

SEQ ID NO: 2366 - protein, 20 aa, Artificial Sequence
  Synthetic peptide
  MISC_FEATURE (1)..(1): N-terminal acetylation
  MISC_FEATURE (20)..(20): C-terminal amidation
DQVWWWGPKARMGLDEYGWE

SEQ ID NO: 2367 - protein, 20 aa, Artificial Sequence
  Synthetic peptide
  MISC_FEATURE (1)..(1): N-terminal acetylation
  MISC_FEATURE (20)..(20): C-terminal amidation
DQVWWWGPKARMGLIDYGWE

SEQ ID NO: 2368 - protein, 20 aa, Artificial Sequence
  Synthetic peptide
  MISC_FEATURE (1)..(1): N-terminal acetylation
  MISC_FEATURE (20)..(20): C-terminal amidation
DQVWWWGPKARMGLIEDGWE

SEQ ID NO: 2369 - protein, 20 aa, Artificial Sequence
  Synthetic peptide
  MISC_FEATURE (1)..(1): N-terminal acetylation
  MISC_FEATURE (20)..(20): C-terminal amidation
DQVWWWGPKARMGLIEYDWE

SEQ ID NO: 2370 - protein, 20 aa, Artificial Sequence
  Synthetic peptide
  MISC_FEATURE (1)..(1): N-terminal acetylation
  MISC_FEATURE (20)..(20): C-terminal amidation
DQVWWWGPKARMGLIEYGDE

SEQ ID NO: 2371 - protein, 20 aa, Artificial Sequence
  Synthetic peptide
  MISC_FEATURE (1)..(1): N-terminal acetylation
  MISC_FEATURE (20)..(20): C-terminal amidation
DQVWWWGPKARMGLIEYGWD

SEQ ID NO: 2372 - protein, 20 aa, Artificial Sequence
  Synthetic peptide
  MISC_FEATURE (1)..(1): N-terminal acetylation
  MISC_FEATURE (20)..(20): C-terminal amidation
GQVWWWGPKARMGLIEYGWE

SEQ ID NO: 2373 - protein, 20 aa, Artificial Sequence
  Synthetic peptide
  MISC_FEATURE (1)..(1): N-terminal acetylation
  MISC_FEATURE (20)..(20): C-terminal amidation
DGVWWWGPKARMGLIEYGWE

SEQ ID NO: 2374 - protein, 20 aa, Artificial Sequence
  Synthetic peptide
  MISC_FEATURE (1)..(1): N-terminal acetylation
  MISC_FEATURE (20)..(20): C-terminal amidation
DQGWWWGPKARMGLIEYGWE

SEQ ID NO: 2375 - protein, 20 aa, Artificial Sequence
  Synthetic peptide
  MISC_FEATURE (1)..(1): N-terminal acetylation
  MISC_FEATURE (20)..(20): C-terminal amidation
DQVGWWGPKARMGLIEYGWE

SEQ ID NO: 2376 - protein, 20 aa, Artificial Sequence
  Synthetic peptide
  MISC_FEATURE (1)..(1): N-terminal acetylation
  MISC_FEATURE (20)..(20): C-terminal amidation
DQVWGWGPKARMGLIEYGWE

SEQ ID NO: 2377 - protein, 20 aa, Artificial Sequence
  Synthetic peptide
  MISC_FEATURE (1)..(1): N-terminal acetylation
  MISC_FEATURE (20)..(20): C-terminal amidation
DQVWWGGPKARMGLIEYGWE

SEQ ID NO: 2378 - protein, 20 aa, Artificial Sequence
  Synthetic peptide
  MISC_FEATURE (1)..(1): N-terminal acetylation
  MISC_FEATURE (20)..(20): C-terminal amidation
DQVWWWGGKARMGLIEYGWE

SEQ ID NO: 2379 - protein, 20 aa, Artificial Sequence
  Synthetic peptide
  MISC_FEATURE (1)..(1): N-terminal acetylation
  MISC_FEATURE (20)..(20): C-terminal amidation
DQVWWWGPGARMGLIEYGWE

SEQ ID NO: 2380 - protein, 20 aa, Artificial Sequence
  Synthetic peptide
  MISC_FEATURE (1)..(1): N-terminal acetylation
  MISC_FEATURE (20)..(20): C-terminal amidation
DQVWWWGPKGRMGLIEYGWE

SEQ ID NO: 2381 - protein, 20 aa, Artificial Sequence
  Synthetic peptide
  MISC_FEATURE (1)..(1): N-terminal acetylation
  MISC_FEATURE (20)..(20): C-terminal amidation
DQVWWWGPKAGMGLIEYGWE

SEQ ID NO: 2382 - protein, 20 aa, Artificial Sequence
  Synthetic peptide
  MISC_FEATURE (1)..(1): N-terminal acetylation
  MISC_FEATURE (20)..(20): C-terminal amidation
DQVWWWGPKARGGLIEYGWE

SEQ ID NO: 2383 - protein, 20 aa, Artificial Sequence
  Synthetic peptide
  MISC_FEATURE (1)..(1): N-terminal acetylation
  MISC_FEATURE (20)..(20): C-terminal amidation
DQVWWWGPKARMGGIEYGWE

SEQ ID NO: 2384 - protein, 20 aa, Artificial Sequence
  Synthetic peptide
  MISC_FEATURE (1)..(1): N-terminal acetylation
  MISC_FEATURE (20)..(20): C-terminal amidation
DQVWWWGPKARMGLGEYGWE

SEQ ID NO: 2385 - protein, 20 aa, Artificial Sequence
  Synthetic peptide
  MISC_FEATURE (1)..(1): N-terminal acetylation
  MISC_FEATURE (20)..(20): C-terminal amidation
DQVWWWGPKARMGLIGYGWE

SEQ ID NO: 2386 - protein, 20 aa, Artificial Sequence
  Synthetic peptide
  MISC_FEATURE (1)..(1): N-terminal acetylation
  MISC_FEATURE (20)..(20): C-terminal amidation
DQVWWWGPKARMGLIEGGWE

SEQ ID NO: 2387 - protein, 20 aa, Artificial Sequence
  Synthetic peptide
  MISC_FEATURE (1)..(1): N-terminal acetylation
  MISC_FEATURE (20)..(20): C-terminal amidation
DQVWWWGPKARMGLIEYGGE

SEQ ID NO: 2388 - protein, 20 aa, Artificial Sequence
  Synthetic peptide
  MISC_FEATURE (1)..(1): N-terminal acetylation
  MISC_FEATURE (20)..(20): C-terminal amidation
DQVWWWGPKARMGLIEYGWG

SEQ ID NO: 2389 - protein, 20 aa, Artificial Sequence
  Synthetic peptide
  MISC_FEATURE (1)..(1): N-terminal acetylation
  MISC_FEATURE (20)..(20): C-terminal amidation
LQVWWWGPKARMGLIEYGWE

SEQ ID NO: 2390 - protein, 20 aa, Artificial Sequence
  Synthetic peptide
  MISC_FEATURE (1)..(1): N-terminal acetylation
  MISC_FEATURE (20)..(20): C-terminal amidation
DLVWWWGPKARMGLIEYGWE

SEQ ID NO: 2391 - protein, 20 aa, Artificial Sequence
  Synthetic peptide
  MISC_FEATURE (1)..(1): N-terminal acetylation
  MISC_FEATURE (20)..(20): C-terminal amidation
DQLWWWGPKARMGLIEYGWE

SEQ ID NO: 2392 - protein, 20 aa, Artificial Sequence
  Synthetic peptide
  MISC_FEATURE (1)..(1): N-terminal acetylation
  MISC_FEATURE (20)..(20): C-terminal amidation
DQVLWWGPKARMGLIEYGWE

SEQ ID NO: 2393 - protein, 20 aa, Artificial Sequence
  Synthetic peptide
  MISC_FEATURE (1)..(1): N-terminal acetylation
  MISC_FEATURE (20)..(20): C-terminal amidation
DQVWLWGPKARMGLIEYGWE

SEQ ID NO: 2394 - protein, 20 aa, Artificial Sequence
  Synthetic peptide
  MISC_FEATURE (1)..(1): N-terminal acetylation
  MISC_FEATURE (20)..(20): C-terminal amidation
DQVWWLGPKARMGLIEYGWE

SEQ ID NO: 2395 - protein, 20 aa, Artificial Sequence
  Synthetic peptide
  MISC_FEATURE (1)..(1): N-terminal acetylation
  MISC_FEATURE (20)..(20): C-terminal amidation
DQVWWWLPKARMGLIEYGWE

SEQ ID NO: 2396 - protein, 20 aa, Artificial Sequence
  Synthetic peptide
  MISC_FEATURE (1)..(1): N-terminal acetylation
  MISC_FEATURE (20)..(20): C-terminal amidation
DQVWWWGLKARMGLIEYGWE

SEQ ID NO: 2397 - protein, 20 aa, Artificial Sequence
  Synthetic peptide
  MISC_FEATURE (1)..(1): N-terminal acetylation
  MISC_FEATURE (20)..(20): C-terminal amidation
DQVWWWGPLARMGLIEYGWE

SEQ ID NO: 2398 - protein, 20 aa, Artificial Sequence
  Synthetic peptide
  MISC_FEATURE (1)..(1): N-terminal acetylation
  MISC_FEATURE (20)..(20): C-terminal amidation
DQVWWWGPKLRMGLIEYGWE

SEQ ID NO: 2399 - protein, 20 aa, Artificial Sequence
  Synthetic peptide
  MISC_FEATURE (1)..(1): N-terminal acetylation
  MISC_FEATURE (20)..(20): C-terminal amidation
DQVWWWGPKALMGLIEYGWE

SEQ ID NO: 2400 - protein, 20 aa, Artificial Sequence
  Synthetic peptide
  MISC_FEATURE (1)..(1): N-terminal acetylation
  MISC_FEATURE (20)..(20): C-terminal amidation
DQVWWWGPKARLGLIEYGWE

SEQ ID NO: 2401 - protein, 20 aa, Artificial Sequence
  Synthetic peptide
  MISC_FEATURE (1)..(1): N-terminal acetylation
  MISC_FEATURE (20)..(20): C-terminal amidation
DQVWWWGPKARMLLIEYGWE

SEQ ID NO: 2402 - protein, 20 aa, Artificial Sequence
  Synthetic peptide
  MISC_FEATURE (1)..(1): N-terminal acetylation
  MISC_FEATURE (20)..(20): C-terminal amidation
DQVWWWGPKARMGLLEYGWE

SEQ ID NO: 2403 - protein, 20 aa, Artificial Sequence
  Synthetic peptide
  MISC_FEATURE (1)..(1): N-terminal acetylation
  MISC_FEATURE (20)..(20): C-terminal amidation
DQVWWWGPKARMGLILYGWE

SEQ ID NO: 2404 - protein, 20 aa, Artificial Sequence
  Synthetic peptide
  MISC_FEATURE (1)..(1): N-terminal acetylation
  MISC_FEATURE (20)..(20): C-terminal amidation
DQVWWWGPKARMGLIELGWE

SEQ ID NO: 2405 - protein, 20 aa, Artificial Sequence
  Synthetic peptide
  MISC_FEATURE (1)..(1): N-terminal acetylation
  MISC_FEATURE (20)..(20): C-terminal amidation
DQVWWWGPKARMGLIEYLWE

SEQ ID NO: 2406 - protein, 20 aa, Artificial Sequence
  Synthetic peptide
  MISC_FEATURE (1)..(1): N-terminal acetylation
  MISC_FEATURE (20)..(20): C-terminal amidation
DQVWWWGPKARMGLIEYGLE

SEQ ID NO: 2407 - protein, 20 aa, Artificial Sequence
  Synthetic peptide
  MISC_FEATURE (1)..(1): N-terminal acetylation
  MISC_FEATURE (20)..(20): C-terminal amidation
DQVWWWGPKARMGLIEYGWL

SEQ ID NO: 2408 - protein, 20 aa, Artificial Sequence
  Synthetic peptide
  MISC_FEATURE (1)..(1): N-terminal acetylation
  MISC_FEATURE (20)..(20): C-terminal amidation
KQVWWWGPKARMGLIEYGWE

SEQ ID NO: 2409 - protein, 20 aa, Artificial Sequence
  Synthetic peptide
  MISC_FEATURE (1)..(1): N-terminal acetylation
  MISC_FEATURE (20)..(20): C-terminal amidation
DKVWWWGPKARMGLIEYGWE

SEQ ID NO: 2410 - protein, 20 aa, Artificial Sequence
  Synthetic peptide
  MISC_FEATURE (1)..(1): N-terminal acetylation
  MISC_FEATURE (20)..(20): C-terminal amidation
DQKWWWGPKARMGLIEYGWE

SEQ ID NO: 2411 - protein, 20 aa, Artificial Sequence
  Synthetic peptide
  MISC_FEATURE (1)..(1): N-terminal acetylation
  MISC_FEATURE (20)..(20): C-terminal amidation
DQVKWWGPKARMGLIEYGWE

SEQ ID NO: 2412 - protein, 20 aa, Artificial Sequence
  Synthetic peptide
  MISC_FEATURE (1)..(1): N-terminal acetylation
  MISC_FEATURE (20)..(20): C-terminal amidation
DQVWKWGPKARMGLIEYGWE

SEQ ID NO: 2413 - protein, 20 aa, Artificial Sequence
  Synthetic peptide
  MISC_FEATURE (1)..(1): N-terminal acetylation
  MISC_FEATURE (20)..(20): C-terminal amidation
DQVWWKGPKARMGLIEYGWE

SEQ ID NO: 2414 - protein, 20 aa, Artificial Sequence
  Synthetic peptide
  MISC_FEATURE (1)..(1): N-terminal acetylation
  MISC_FEATURE (20)..(20): C-terminal amidation
DQVWWWKPKARMGLIEYGWE

SEQ ID NO: 2415 - protein, 20 aa, Artificial Sequence
  Synthetic peptide
  MISC_FEATURE (1)..(1): N-terminal acetylation
  MISC_FEATURE (20)..(20): C-terminal amidation
DQVWWWGKKARMGLIEYGWE

SEQ ID NO: 2416 - protein, 20 aa, Artificial Sequence
  Synthetic peptide
  MISC_FEATURE (1)..(1): N-terminal acetylation
  MISC_FEATURE (20)..(20): C-terminal amidation
DQVWWWGPKKRMGLIEYGWE

SEQ ID NO: 2417 - protein, 20 aa, Artificial Sequence
  Synthetic peptide
  MISC_FEATURE (1)..(1): N-terminal acetylation
  MISC_FEATURE (20)..(20): C-terminal amidation
DQVWWWGPKAKMGLIEYGWE

SEQ ID NO: 2418 - protein, 20 aa, Artificial Sequence
  Synthetic peptide
  MISC_FEATURE (1)..(1): N-terminal acetylation
  MISC_FEATURE (20)..(20): C-terminal amidation
DQVWWWGPKARKGLIEYGWE

SEQ ID NO: 2419 - protein, 20 aa, Artificial Sequence
  Synthetic peptide
  MISC_FEATURE (1)..(1): N-terminal acetylation
  MISC_FEATURE (20)..(20): C-terminal amidation
DQVWWWGPKARMKLIEYGWE

SEQ ID NO: 2420 - protein, 20 aa, Artificial Sequence
  Synthetic peptide
  MISC_FEATURE (1)..(1): N-terminal acetylation
  MISC_FEATURE (20)..(20): C-terminal amidation
DQVWWWGPKARMGKIEYGWE

SEQ ID NO: 2421 - protein, 20 aa, Artificial Sequence
  Synthetic peptide
  MISC_FEATURE (1)..(1): N-terminal acetylation
  MISC_FEATURE (20)..(20): C-terminal amidation
DQVWWWGPKARMGLKEYGWE

SEQ ID NO: 2422 - protein, 20 aa, Artificial Sequence
  Synthetic peptide
  MISC_FEATURE (1)..(1): N-terminal acetylation
  MISC_FEATURE (20)..(20): C-terminal amidation
DQVWWWGPKARMGLIKYGWE

SEQ ID NO: 2423 - protein, 20 aa, Artificial Sequence
  Synthetic peptide
  MISC_FEATURE (1)..(1): N-terminal acetylation
  MISC_FEATURE (20)..(20): C-terminal amidation
DQVWWWGPKARMGLIEKGWE

SEQ ID NO: 2424 - protein, 20 aa, Artificial Sequence
  Synthetic peptide
  MISC_FEATURE (1)..(1): N-terminal acetylation
  MISC_FEATURE (20)..(20): C-terminal amidation
DQVWWWGPKARMGLIEYKWE

SEQ ID NO: 2425 - protein, 20 aa, Artificial Sequence
  Synthetic peptide
  MISC_FEATURE (1)..(1): N-terminal acetylation
  MISC_FEATURE (20)..(20): C-terminal amidation
DQVWWWGPKARMGLIEYGKE

SEQ ID NO: 2426 - protein, 20 aa, Artificial Sequence
  Synthetic peptide
  MISC_FEATURE (1)..(1): N-terminal acetylation
  MISC_FEATURE (20)..(20): C-terminal amidation
DQVWWWGPKARMGLIEYGWK

SEQ ID NO: 2427 - protein, 20 aa, Artificial Sequence
  Synthetic peptide
  MISC_FEATURE (1)..(1): N-terminal acetylation
  MISC_FEATURE (20)..(20): C-terminal amidation
FQVWWWGPKARMGLIEYGWE

SEQ ID NO: 2428 - protein, 20 aa, Artificial Sequence
  Synthetic peptide
  MISC_FEATURE (1)..(1): N-terminal acetylation
  MISC_FEATURE (20)..(20): C-terminal amidation
DFVWWWGPKARMGLIEYGWE

SEQ ID NO: 2429 - protein, 20 aa, Artificial Sequence
  Synthetic peptide
  MISC_FEATURE (1)..(1): N-terminal acetylation
  MISC_FEATURE (20)..(20): C-terminal amidation
DQFWWWGPKARMGLIEYGWE

SEQ ID NO: 2430 - protein, 20 aa, Artificial Sequence
  Synthetic peptide
  MISC_FEATURE (1)..(1): N-terminal acetylation
  MISC_FEATURE (20)..(20): C-terminal amidation
DQVFWWGPKARMGLIEYGWE

SEQ ID NO: 2431 - protein, 20 aa, Artificial Sequence
  Synthetic peptide
  MISC_FEATURE (1)..(1): N-terminal acetylation
  MISC_FEATURE (20)..(20): C-terminal amidation
DQVWFWGPKARMGLIEYGWE

SEQ ID NO: 2432 - protein, 20 aa, Artificial Sequence
  Synthetic peptide
  MISC_FEATURE (1)..(1): N-terminal acetylation
  MISC_FEATURE (20)..(20): C-terminal amidation
DQVWWFGPKARMGLIEYGWE

SEQ ID NO: 2433 - protein, 20 aa, Artificial Sequence
  Synthetic peptide
  MISC_FEATURE (1)..(1): N-terminal acetylation
  MISC_FEATURE (20)..(20): C-terminal amidation
DQVWWWFPKARMGLIEYGWE

SEQ ID NO: 2434 - protein, 20 aa, Artificial Sequence
  Synthetic peptide
  MISC_FEATURE (1)..(1): N-terminal acetylation
  MISC_FEATURE (20)..(20): C-terminal amidation
DQVWWWGFKARMGLIEYGWE

SEQ ID NO: 2435 - protein, 20 aa, Artificial Sequence
  Synthetic peptide
  MISC_FEATURE (1)..(1): N-terminal acetylation
  MISC_FEATURE (20)..(20): C-terminal amidation
DQVWWWGPFARMGLIEYGWE

SEQ ID NO: 2436 - protein, 20 aa, Artificial Sequence
  Synthetic peptide
  MISC_FEATURE (1)..(1): N-terminal acetylation
  MISC_FEATURE (20)..(20): C-terminal amidation
DQVWWWGPKFRMGLIEYGWE

SEQ ID NO: 2437 - protein, 20 aa, Artificial Sequence
  Synthetic peptide
  MISC_FEATURE (1)..(1): N-terminal acetylation
  MISC_FEATURE (20)..(20): C-terminal amidation
DQVWWWGPKAFMGLIEYGWE

SEQ ID NO: 2438 - protein, 20 aa, Artificial Sequence
  Synthetic peptide
  MISC_FEATURE (1)..(1): N-terminal acetylation
  MISC_FEATURE (20)..(20): C-terminal amidation
DQVWWWGPKARFGLIEYGWE

SEQ ID NO: 2439 - protein, 20 aa, Artificial Sequence
  Synthetic peptide
  MISC_FEATURE (1)..(1): N-terminal acetylation
  MISC_FEATURE (20)..(20): C-terminal amidation
DQVWWWGPKARMFLIEYGWE

SEQ ID NO: 2440 - protein, 20 aa, Artificial Sequence
  Synthetic peptide
  MISC_FEATURE (1)..(1): N-terminal acetylation
  MISC_FEATURE (20)..(20): C-terminal amidation
DQVWWWGPKARMGFIEYGWE

SEQ ID NO: 2441 - protein, 20 aa, Artificial Sequence
  Synthetic peptide
  MISC_FEATURE (1)..(1): N-terminal acetylation
  MISC_FEATURE (20)..(20): C-terminal amidation
DQVWWWGPKARMGLFEYGWE

SEQ ID NO: 2442 - protein, 20 aa, Artificial Sequence
  Synthetic peptide
  MISC_FEATURE (1)..(1): N-terminal acetylation
  MISC_FEATURE (20)..(20): C-terminal amidation
DQVWWWGPKARMGLIFYGWE

SEQ ID NO: 2443 - protein, 20 aa, Artificial Sequence
  Synthetic peptide
  MISC_FEATURE (1)..(1): N-terminal acetylation
  MISC_FEATURE (20)..(20): C-terminal amidation
DQVWWWGPKARMGLIEFGWE

SEQ ID NO: 2444 - protein, 20 aa, Artificial Sequence
  Synthetic peptide
  MISC_FEATURE (1)..(1): N-terminal acetylation
  MISC_FEATURE (20)..(20): C-terminal amidation
DQVWWWGPKARMGLIEYFWE

SEQ ID NO: 2445 - protein, 20 aa, Artificial Sequence
  Synthetic peptide
  MISC_FEATURE (1)..(1): N-terminal acetylation
  MISC_FEATURE (20)..(20): C-terminal amidation
DQVWWWGPKARMGLIEYGFE

SEQ ID NO: 2446 - protein, 20 aa, Artificial Sequence
  Synthetic peptide
  MISC_FEATURE (1)..(1): N-terminal acetylation
  MISC_FEATURE (20)..(20): C-terminal amidation
DQVWWWGPKARMGLIEYGWF

SEQ ID NO: 2447 - protein, 20 aa, Artificial Sequence
  Synthetic peptide
  MISC_FEATURE (1)..(1): N-terminal acetylation
  MISC_FEATURE (20)..(20): C-terminal amidation
PQVWWWGPKARMGLIEYGWE

SEQ ID NO: 2448 - protein, 20 aa, Artificial Sequence
  Synthetic peptide
  MISC_FEATURE (1)..(1): N-terminal acetylation
  MISC_FEATURE (20)..(20): C-terminal amidation
DPVWWWGPKARMGLIEYGWE

SEQ ID NO: 2449 - protein, 20 aa, Artificial Sequence
  Synthetic peptide
  MISC_FEATURE (1)..(1): N-terminal acetylation
  MISC_FEATURE (20)..(20): C-terminal amidation
DQPWWWGPKARMGLIEYGWE

SEQ ID NO: 2450 - protein, 20 aa, Artificial Sequence
  Synthetic peptide
  MISC_FEATURE (1)..(1): N-terminal acetylation
  MISC_FEATURE (20)..(20): C-terminal amidation
DQVPWWGPKARMGLIEYGWE

SEQ ID NO: 2451 - protein, 20 aa, Artificial Sequence
  Synthetic peptide
  MISC_FEATURE (1)..(1): N-terminal acetylation
  MISC_FEATURE (20)..(20): C-terminal amidation
DQVWPWGPKARMGLIEYGWE

SEQ ID NO: 2452 - protein, 20 aa, Artificial Sequence
  Synthetic peptide
  MISC_FEATURE (1)..(1): N-terminal acetylation
  MISC_FEATURE (20)..(20): C-terminal amidation
DQVWWPGPKARMGLIEYGWE

SEQ ID NO: 2453 - protein, 20 aa, Artificial Sequence
  Synthetic peptide
  MISC_FEATURE (1)..(1): N-terminal acetylation
  MISC_FEATURE (20)..(20): C-terminal amidation
DQVWWWPPKARMGLIEYGWE

SEQ ID NO: 2454 - protein, 20 aa, Artificial Sequence
  Synthetic peptide
  MISC_FEATURE (1)..(1): N-terminal acetylation
  MISC_FEATURE (20)..(20): C-terminal amidation
DQVWWWGPPARMGLIEYGWE

SEQ ID NO: 2455 - protein, 20 aa, Artificial Sequence
  Synthetic peptide
  MISC_FEATURE (1)..(1): N-terminal acetylation
  MISC_FEATURE (20)..(20): C-terminal amidation
DQVWWWGPKPRMGLIEYGWE

SEQ ID NO: 2456 - protein, 20 aa, Artificial Sequence
  Synthetic peptide
  MISC_FEATURE (1)..(1): N-terminal acetylation
  MISC_FEATURE (20)..(20): C-terminal amidation
DQVWWWGPKAPMGLIEYGWE

SEQ ID NO: 2457 - protein, 20 aa, Artificial Sequence
  Synthetic peptide
  MISC_FEATURE (1)..(1): N-terminal acetylation
  MISC_FEATURE (20)..(20): C-terminal amidation
DQVWWWGPKARPGLIEYGWE

SEQ ID NO: 2458 - protein, 20 aa, Artificial Sequence
  Synthetic peptide
  MISC_FEATURE (1)..(1): N-terminal acetylation
  MISC_FEATURE (20)..(20): C-terminal amidation
DQVWWWGPKARMPLIEYGWE

SEQ ID NO: 2459 - protein, 20 aa, Artificial Sequence
  Synthetic peptide
  MISC_FEATURE (1)..(1): N-terminal acetylation
  MISC_FEATURE (20)..(20): C-terminal amidation
DQVWWWGPKARMGPIEYGWE

SEQ ID NO: 2460 - protein, 20 aa, Artificial Sequence
  Synthetic peptide
  MISC_FEATURE (1)..(1): N-terminal acetylation
  MISC_FEATURE (20)..(20): C-terminal amidation
DQVWWWGPKARMGLPEYGWE

SEQ ID NO: 2461 - protein, 20 aa, Artificial Sequence
  Synthetic peptide
  MISC_FEATURE (1)..(1): N-terminal acetylation
  MISC_FEATURE (20)..(20): C-terminal amidation
DQVWWWGPKARMGLIPYGWE

SEQ ID NO: 2462 - protein, 20 aa, Artificial Sequence
  Synthetic peptide
  MISC_FEATURE (1)..(1): N-terminal acetylation
  MISC_FEATURE (20)..(20): C-terminal amidation
DQVWWWGPKARMGLIEPGWE

SEQ ID NO: 2463 - protein, 20 aa, Artificial Sequence
  Synthetic peptide
  MISC_FEATURE (1)..(1): N-terminal acetylation
  MISC_FEATURE (20)..(20): C-terminal amidation
DQVWWWGPKARMGLIEYPWE

SEQ ID NO: 2464 - protein, 20 aa, Artificial Sequence
  Synthetic peptide
  MISC_FEATURE (1)..(1): N-terminal acetylation
  MISC_FEATURE (20)..(20): C-terminal amidation
DQVWWWGPKARMGLIEYGPE

SEQ ID NO: 2465 - protein, 20 aa, Artificial Sequence
  Synthetic peptide
  MISC_FEATURE (1)..(1): N-terminal acetylation
  MISC_FEATURE (20)..(20): C-terminal amidation
DQVWWWGPKARMGLIEYGWP

SEQ ID NO: 2466 - protein, 20 aa, Artificial Sequence
  Synthetic peptide
  MISC_FEATURE (1)..(1): N-terminal acetylation
  MISC_FEATURE (20)..(20): C-terminal amidation
SQVWWWGPKARMGLIEYGWE

SEQ ID NO: 2467 - protein, 20 aa, Artificial Sequence
  Synthetic peptide
  MISC_FEATURE (1)..(1): N-terminal acetylation
  MISC_FEATURE (20)..(20): C-terminal amidation
DSVWWWGPKARMGLIEYGWE

SEQ ID NO: 2468 - protein, 20 aa, Artificial Sequence
  Synthetic peptide
  MISC_FEATURE (1)..(1): N-terminal acetylation
  MISC_FEATURE (20)..(20): C-terminal amidation
DQSWWWGPKARMGLIEYGWE

SEQ ID NO: 2469 - protein, 20 aa, Artificial Sequence
  Synthetic peptide
  MISC_FEATURE (1)..(1): N-terminal acetylation
  MISC_FEATURE (20)..(20): C-terminal amidation
DQVSWWGPKARMGLIEYGWE

SEQ ID NO: 2470 - protein, 20 aa, Artificial Sequence
  Synthetic peptide
  MISC_FEATURE (1)..(1): N-terminal acetylation
  MISC_FEATURE (20)..(20): C-terminal amidation
DQVWSWGPKARMGLIEYGWE

SEQ ID NO: 2471 - protein, 20 aa, Artificial Sequence
  Synthetic peptide
  MISC_FEATURE (1)..(1): N-terminal acetylation
  MISC_FEATURE (20)..(20): C-terminal amidation
DQVWWSGPKARMGLIEYGWE

SEQ ID NO: 2472 - protein, 20 aa, Artificial Sequence
  Synthetic peptide
  MISC_FEATURE (1)..(1): N-terminal acetylation
  MISC_FEATURE (20)..(20): C-terminal amidation
DQVWWWSPKARMGLIEYGWE

SEQ ID NO: 2473 - protein, 20 aa, Artificial Sequence
  Synthetic peptide
  MISC_FEATURE (1)..(1): N-terminal acetylation
  MISC_FEATURE (20)..(20): C-terminal amidation
DQVWWWGSKARMGLIEYGWE

SEQ ID NO: 2474 - protein, 20 aa, Artificial Sequence
  Synthetic peptide
  MISC_FEATURE (1)..(1): N-terminal acetylation
  MISC_FEATURE (20)..(20): C-terminal amidation
DQVWWWGPSARMGLIEYGWE

SEQ ID NO: 2475 - protein, 20 aa, Artificial Sequence
  Synthetic peptide
  MISC_FEATURE (1)..(1): N-terminal acetylation
  MISC_FEATURE (20)..(20): C-terminal amidation
DQVWWWGPKSRMGLIEYGWE

SEQ ID NO: 2476 - protein, 20 aa, Artificial Sequence
  Synthetic peptide
  MISC_FEATURE (1)..(1): N-terminal acetylation
  MISC_FEATURE (20)..(20): C-terminal amidation
DQVWWWGPKASMGLIEYGWE

SEQ ID NO: 2477 - protein, 20 aa, Artificial Sequence
  Synthetic peptide
  MISC_FEATURE (1)..(1): N-terminal acetylation
  MISC_FEATURE (20)..(20): C-terminal amidation
DQVWWWGPKARSGLIEYGWE

SEQ ID NO: 2478 - protein, 20 aa, Artificial Sequence
  Synthetic peptide
  MISC_FEATURE (1)..(1): N-terminal acetylation
  MISC_FEATURE (20)..(20): C-terminal amidation
DQVWWWGPKARMSLIEYGWE

SEQ ID NO: 2479 - protein, 20 aa, Artificial Sequence
  Synthetic peptide
  MISC_FEATURE (1)..(1): N-terminal acetylation
  MISC_FEATURE (20)..(20): C-terminal amidation
DQVWWWGPKARMGSIEYGWE

SEQ ID NO: 2480 - protein, 20 aa, Artificial Sequence
  Synthetic peptide
  MISC_FEATURE (1)..(1): N-terminal acetylation
  MISC_FEATURE (20)..(20): C-terminal amidation
DQVWWWGPKARMGLSEYGWE

SEQ ID NO: 2481 - protein, 20 aa, Artificial Sequence
  Synthetic peptide
  MISC_FEATURE (1)..(1): N-terminal acetylation
  MISC_FEATURE (20)..(20): C-terminal amidation
DQVWWWGPKARMGLISYGWE

SEQ ID NO: 2482 - protein, 20 aa, Artificial Sequence
  Synthetic peptide
  MISC_FEATURE (1)..(1): N-terminal acetylation
  MISC_FEATURE (20)..(20): C-terminal amidation
DQVWWWGPKARMGLIESGWE

SEQ ID NO: 2483 - protein, 20 aa, Artificial Sequence
  Synthetic peptide
  MISC_FEATURE (1)..(1): N-terminal acetylation
  MISC_FEATURE (20)..(20): C-terminal amidation
DQVWWWGPKARMGLIEYSWE

SEQ ID NO: 2484 - protein, 20 aa, Artificial Sequence
  Synthetic peptide
  MISC_FEATURE (1)..(1): N-terminal acetylation
  MISC_FEATURE (20)..(20): C-terminal amidation
DQVWWWGPKARMGLIEYGSE

SEQ ID NO: 2485 - protein, 20 aa, Artificial Sequence
  Synthetic peptide
  MISC_FEATURE (1)..(1): N-terminal acetylation
  MISC_FEATURE (20)..(20): C-terminal amidation
DQVWWWGPKARMGLIEYGWS

SEQ ID NO: 2486 - protein, 17 aa, Artificial Sequence
  Synthetic peptide
  MISC_FEATURE (1)..(1): N-terminal acetylation
  MISC_FEATURE (17)..(17): C-terminal amidation
DQVWWWGPKARMGLIEY

SEQ ID NO: 2487 - protein, 14 aa, Artificial Sequence
  Synthetic peptide
  MISC_FEATURE (1)..(1): N-terminal acetylation
  MISC_FEATURE (14)..(14): C-terminal amidation
DQVWWWGPKARMGL

SEQ ID NO: 2488 - protein, 11 aa, Artificial Sequence
  Synthetic peptide
  MISC_FEATURE (1)..(1): N-terminal acetylation
  MISC_FEATURE (11)..(11): C-terminal amidation
DQVWWWGPKAR

SEQ ID NO: 2489 - protein, 17 aa, Artificial Sequence
  Synthetic peptide
  MISC_FEATURE (1)..(1): N-terminal acetylation
  MISC_FEATURE (17)..(17): C-terminal amidation
WWWGPKARMGLIEYGWE

SEQ ID NO: 2490 - protein, 14 aa, Artificial Sequence
  Synthetic peptide
  MISC_FEATURE (1)..(1): N-terminal acetylation
  MISC_FEATURE (14)..(14): C-terminal amidation
GPKARMGLIEYGWE

SEQ ID NO: 2491 - protein, 11 aa, Artificial Sequence
  Synthetic peptide
  MISC_FEATURE (1)..(1): N-terminal acetylation
  MISC_FEATURE (11)..(11): C-terminal amidation
ARMGLIEYGWE

SEQ ID NO: 2492 - protein, 14 aa, Artificial Sequence
  Synthetic peptide
  MISC_FEATURE (1)..(1): N-terminal acetylation
  MISC_FEATURE (14)..(14): C-terminal amidation
WWWGPKARMGLIEY

SEQ ID NO: 2493 - protein, 20 aa, Artificial Sequence
  Synthetic peptide
  MISC_FEATURE (1)..(1): N-terminal acetylation
  MISC_FEATURE (20)..(20): C-terminal amidation
AEVGWYNVVTQKHSKLGMLI

SEQ ID NO: 2494 - protein, 20 aa, Artificial Sequence
  Synthetic peptide
  MISC_FEATURE (1)..(1): N-terminal acetylation
  MISC_FEATURE (20)..(20): C-terminal amidation
IAVGWYNVVTQKHSKLGMLI

SEQ ID NO: 2495 - protein, 20 aa, Artificial Sequence
  Synthetic peptide
  MISC_FEATURE (1)..(1): N-terminal acetylation
  MISC_FEATURE (20)..(20): C-terminal amidation
IEAGWYNVVTQKHSKLGMLI

SEQ ID NO: 2496 - protein, 20 aa, Artificial Sequence
  Synthetic peptide
  MISC_FEATURE (1)..(1): N-terminal acetylation
  MISC_FEATURE (20)..(20): C-terminal amidation
IEVAWYNVVTQKHSKLGMLI

SEQ ID NO: 2497 - protein, 20 aa, Artificial Sequence
  Synthetic peptide
  MISC_FEATURE (1)..(1): N-terminal acetylation
  MISC_FEATURE (20)..(20): C-terminal amidation
IEVGAYNVVTQKHSKLGMLI

SEQ ID NO: 2498 - protein, 20 aa, Artificial Sequence
  Synthetic peptide
  MISC_FEATURE (1)..(1): N-terminal acetylation
  MISC_FEATURE (20)..(20): C-terminal amidation
IEVGWANVVTQKHSKLGMLI

SEQ ID NO: 2499 - protein, 20 aa, Artificial Sequence
  Synthetic peptide
  MISC_FEATURE (1)..(1): N-terminal acetylation
  MISC_FEATURE (20)..(20): C-terminal amidation
IEVGWYAVVTQKHSKLGMLI

SEQ ID NO: 2500 - protein, 20 aa, Artificial Sequence
  Synthetic peptide
  MISC_FEATURE (1)..(1): N-terminal acetylation
  MISC_FEATURE (20)..(20): C-terminal amidation
IEVGWYNAVTQKHSKLGMLI

SEQ ID NO: 2501 - protein, 20 aa, Artificial Sequence
  Synthetic peptide
  MISC_FEATURE (1)..(1): N-terminal acetylation
  MISC_FEATURE (20)..(20): C-terminal amidation
IEVGWYNVATQKHSKLGMLI

SEQ ID NO: 2502 - protein, 20 aa, Artificial Sequence
  Synthetic peptide
  MISC_FEATURE (1)..(1): N-terminal acetylation
  MISC_FEATURE (20)..(20): C-terminal amidation
IEVGWYNVVAQKHSKLGMLI

SEQ ID NO: 2503 - protein, 20 aa, Artificial Sequence
  Synthetic peptide
  MISC_FEATURE (1)..(1): N-terminal acetylation
  MISC_FEATURE (20)..(20): C-terminal amidation
IEVGWYNVVTAKHSKLGMLI

SEQ ID NO: 2504 - protein, 20 aa, Artificial Sequence
  Synthetic peptide
  MISC_FEATURE (1)..(1): N-terminal acetylation
  MISC_FEATURE (20)..(20): C-terminal amidation
IEVGWYNVVTQAHSKLGMLI

SEQ ID NO: 2505 - protein, 20 aa, Artificial Sequence
  Synthetic peptide
  MISC_FEATURE (1)..(1): N-terminal acetylation
  MISC_FEATURE (20)..(20): C-terminal amidation
IEVGWYNVVTQKASKLGMLI

SEQ ID NO: 2506 - protein, 20 aa, Artificial Sequence
  Synthetic peptide
  MISC_FEATURE (1)..(1): N-terminal acetylation
  MISC_FEATURE (20)..(20): C-terminal amidation
IEVGWYNVVTQKHAKLGMLI

SEQ ID NO: 2507 - protein, 20 aa, Artificial Sequence
  Synthetic peptide
  MISC_FEATURE (1)..(1): N-terminal acetylation
  MISC_FEATURE (20)..(20): C-terminal amidation
IEVGWYNVVTQKHSALGMLI

SEQ ID NO: 2508 - protein, 20 aa, Artificial Sequence
  Synthetic peptide
  MISC_FEATURE (1)..(1): N-terminal acetylation
  MISC_FEATURE (20)..(20): C-terminal amidation
IEVGWYNVVTQKHSKAGMLI

SEQ ID NO: 2509 - protein, 20 aa, Artificial Sequence
  Synthetic peptide
  MISC_FEATURE (1)..(1): N-terminal acetylation
  MISC_FEATURE (20)..(20): C-terminal amidation
IEVGWYNVVTQKHSKLAMLI

SEQ ID NO: 2510 - protein, 20 aa, Artificial Sequence
  Synthetic peptide
  MISC_FEATURE (1)..(1): N-terminal acetylation
  MISC_FEATURE (20)..(20): C-terminal amidation
IEVGWYNVVTQKHSKLGALI

SEQ ID NO: 2511 - protein, 20 aa, Artificial Sequence
  Synthetic peptide
  MISC_FEATURE (1)..(1): N-terminal acetylation
  MISC_FEATURE (20)..(20): C-terminal amidation
IEVGWYNVVTQKHSKLGMAI

SEQ ID NO: 2512 - protein, 20 aa, Artificial Sequence
  Synthetic peptide
  MISC_FEATURE (1)..(1): N-terminal acetylation
  MISC_FEATURE (20)..(20): C-terminal amidation
IEVGWYNVVTQKHSKLGMLA

SEQ ID NO: 2513 - protein, 20 aa, Artificial Sequence
  Synthetic peptide
  MISC_FEATURE (1)..(1): N-terminal acetylation
  MISC_FEATURE (20)..(20): C-terminal amidation
DEVGWYNVVTQKHSKLGMLI

SEQ ID NO: 2514 - protein, 20 aa, Artificial Sequence
  Synthetic peptide
  MISC_FEATURE (1)..(1): N-terminal acetylation
  MISC_FEATURE (20)..(20): C-terminal amidation
IDVGWYNVVTQKHSKLGMLI

SEQ ID NO: 2515 - protein, 20 aa, Artificial Sequence
  Synthetic peptide
  MISC_FEATURE (1)..(1): N-terminal acetylation
  MISC_FEATURE (20)..(20): C-terminal amidation
IEDGWYNVVTQKHSKLGMLI

SEQ ID NO: 2516 - protein, 20 aa, Artificial Sequence
  Synthetic peptide
  MISC_FEATURE (1)..(1): N-terminal acetylation
  MISC_FEATURE (20)..(20): C-terminal amidation
IEVDWYNVVTQKHSKLGMLI

SEQ ID NO: 2517 - protein, 20 aa, Artificial Sequence
  Synthetic peptide
  MISC_FEATURE (1)..(1): N-terminal acetylation
  MISC_FEATURE (20)..(20): C-terminal amidation
IEVGDYNVVTQKHSKLGMLI

SEQ ID NO: 2518 - protein, 20 aa, Artificial Sequence
  Synthetic peptide
  MISC_FEATURE (1)..(1): N-terminal acetylation
  MISC_FEATURE (20)..(20): C-terminal amidation
IEVGWDNVVTQKHSKLGMLI

SEQ ID NO: 2519 - protein, 20 aa, Artificial Sequence
  Synthetic peptide
  MISC_FEATURE (1)..(1): N-terminal acetylation
  MISC_FEATURE (20)..(20): C-terminal amidation
IEVGWYDVVTQKHSKLGMLI

SEQ ID NO: 2520 - protein, 20 aa, Artificial Sequence
  Synthetic peptide
  MISC_FEATURE (1)..(1): N-terminal acetylation
  MISC_FEATURE (20)..(20): C-terminal amidation
IEVGWYNDVTQKHSKLGMLI

SEQ ID NO: 2521 - protein, 20 aa, Artificial Sequence
  Synthetic peptide
  MISC_FEATURE (1)..(1): N-terminal acetylation
  MISC_FEATURE (20)..(20): C-terminal amidation
IEVGWYNVDTQKHSKLGMLI

SEQ ID NO: 2522 - protein, 20 aa, Artificial Sequence
  Synthetic peptide
  MISC_FEATURE (1)..(1): N-terminal acetylation
  MISC_FEATURE (20)..(20): C-terminal amidation
IEVGWYNVVDQKHSKLGMLI

SEQ ID NO: 2523 - protein, 20 aa, Artificial Sequence
  Synthetic peptide
  MISC_FEATURE (1)..(1): N-terminal acetylation
  MISC_FEATURE (20)..(20): C-terminal amidation
IEVGWYNVVTDKHSKLGMLI

SEQ ID NO: 2524 - protein, 20 aa, Artificial Sequence
  Synthetic peptide
  MISC_FEATURE (1)..(1): N-terminal acetylation
  MISC_FEATURE (20)..(20): C-terminal amidation
IEVGWYNVVTQDHSKLGMLI

SEQ ID NO: 2525 - protein, 20 aa, Artificial Sequence
  Synthetic peptide
  MISC_FEATURE (1)..(1): N-terminal acetylation
  MISC_FEATURE (20)..(20): C-terminal amidation
IEVGWYNVVTQKDSKLGMLI

SEQ ID NO: 2526 - protein, 20 aa, Artificial Sequence
  Synthetic peptide
  MISC_FEATURE (1)..(1): N-terminal acetylation
  MISC_FEATURE (20)..(20): C-terminal amidation
IEVGWYNVVTQKHDKLGMLI

SEQ ID NO: 2527 - protein, 20 aa, Artificial Sequence
  Synthetic peptide
  MISC_FEATURE (1)..(1): N-terminal acetylation
  MISC_FEATURE (20)..(20): C-terminal amidation
IEVGWYNVVTQKHSDLGMLI

SEQ ID NO: 2528 - protein, 20 aa, Artificial Sequence
  Synthetic peptide
  MISC_FEATURE (1)..(1): N-terminal acetylation
  MISC_FEATURE (20)..(20): C-terminal amidation
IEVGWYNVVTQKHSKDGMLI

SEQ ID NO: 2529 - protein, 20 aa, Artificial Sequence
  Synthetic peptide
  MISC_FEATURE (1)..(1): N-terminal acetylation
  MISC_FEATURE (20)..(20): C-terminal amidation
IEVGWYNVVTQKHSKLDMLI

SEQ ID NO: 2530 - protein, 20 aa, Artificial Sequence
  Synthetic peptide
  MISC_FEATURE (1)..(1): N-terminal acetylation
  MISC_FEATURE (20)..(20): C-terminal amidation
IEVGWYNVVTQKHSKLGDLI

SEQ ID NO: 2531 - protein, 20 aa, Artificial Sequence
  Synthetic peptide
  MISC_FEATURE (1)..(1): N-terminal acetylation
  MISC_FEATURE (20)..(20): C-terminal amidation
IEVGWYNVVTQKHSKLGMDI

SEQ ID NO: 2532 - protein, 20 aa, Artificial Sequence
  Synthetic peptide
  MISC_FEATURE (1)..(1): N-terminal acetylation
  MISC_FEATURE (20)..(20): C-terminal amidation
IEVGWYNVVTQKHSKLGMLD

SEQ ID NO: 2533 - protein, 20 aa, Artificial Sequence
  Synthetic peptide
  MISC_FEATURE (1)..(1): N-terminal acetylation
  MISC_FEATURE (20)..(20): C-terminal amidation
GEVGWYNVVTQKHSKLGMLI

SEQ ID NO: 2534 - protein, 20 aa, Artificial Sequence
  Synthetic peptide
  MISC_FEATURE (1)..(1): N-terminal acetylation
  MISC_FEATURE (20)..(20): C-terminal amidation
IGVGWYNVVTQKHSKLGMLI

SEQ ID NO: 2535 - protein, 20 aa, Artificial Sequence
  Synthetic peptide
  MISC_FEATURE (1)..(1): N-terminal acetylation
  MISC_FEATURE (20)..(20): C-terminal amidation
IEGGWYNVVTQKHSKLGMLI

SEQ ID NO: 2536 - protein, 20 aa, Artificial Sequence
  Synthetic peptide
  MISC_FEATURE (1)..(1): N-terminal acetylation
  MISC_FEATURE (20)..(20): C-terminal amidation
IEVGGYNVVTQKHSKLGMLI

SEQ ID NO: 2537 - protein, 20 aa, Artificial Sequence
  Synthetic peptide
  MISC_FEATURE (1)..(1): N-terminal acetylation
  MISC_FEATURE (20)..(20): C-terminal amidation
IEVGWGNVVTQKHSKLGMLI

SEQ ID NO: 2538 - protein, 20 aa, Artificial Sequence
  Synthetic peptide
  MISC_FEATURE (1)..(1): N-terminal acetylation
  MISC_FEATURE (20)..(20): C-terminal amidation
IEVGWYGVVTQKHSKLGMLI

SEQ ID NO: 2539 - protein, 20 aa, Artificial Sequence
  Synthetic peptide
  MISC_FEATURE (1)..(1): N-terminal acetylation
  MISC_FEATURE (20)..(20): C-terminal amidation
IEVGWYNGVTQKHSKLGMLI

SEQ ID NO: 2540 - protein, 20 aa, Artificial Sequence
  Synthetic peptide
  MISC_FEATURE (1)..(1): N-terminal acetylation
  MISC_FEATURE (20)..(20): C-terminal amidation
IEVGWYNVGTQKHSKLGMLI

SEQ ID NO: 2541 - protein, 20 aa, Artificial Sequence
  Synthetic peptide
  MISC_FEATURE (1)..(1): N-terminal acetylation
  MISC_FEATURE (20)..(20): C-terminal amidation
IEVGWYNVVGQKHSKLGMLI

SEQ ID NO: 2542 - protein, 20 aa, Artificial Sequence
  Synthetic peptide
  MISC_FEATURE (1)..(1): N-terminal acetylation
  MISC_FEATURE (20)..(20): C-terminal amidation
IEVGWYNVVTGKHSKLGMLI

SEQ ID NO: 2543 - protein, 20 aa, Artificial Sequence
  Synthetic peptide
  MISC_FEATURE (1)..(1): N-terminal acetylation
  MISC_FEATURE (20)..(20): C-terminal amidation
IEVGWYNVVTQGHSKLGMLI

SEQ ID NO: 2544 - protein, 20 aa, Artificial Sequence
  Synthetic peptide
  MISC_FEATURE (1)..(1): N-terminal acetylation
  MISC_FEATURE (20)..(20): C-terminal amidation
IEVGWYNVVTQKGSKLGMLI

SEQ ID NO: 2545 - protein, 20 aa, Artificial Sequence
  Synthetic peptide
  MISC_FEATURE (1)..(1): N-terminal acetylation
  MISC_FEATURE (20)..(20): C-terminal amidation
IEVGWYNVVTQKHGKLGMLI

SEQ ID NO: 2546 - protein, 20 aa, Artificial Sequence
  Synthetic peptide
  MISC_FEATURE (1)..(1): N-terminal acetylation
  MISC_FEATURE (20)..(20): C-terminal amidation
IEVGWYNVVTQKHSGLGMLI

SEQ ID NO: 2547 - protein, 20 aa, Artificial Sequence
  Synthetic peptide
  MISC_FEATURE (1)..(1): N-terminal acetylation
  MISC_FEATURE (20)..(20): C-terminal amidation
IEVGWYNVVTQKHSKGGMLI

SEQ ID NO: 2548 - protein, 20 aa, Artificial Sequence
  Synthetic peptide
  MISC_FEATURE (1)..(1): N-terminal acetylation
  MISC_FEATURE (20)..(20): C-terminal amidation
IEVGWYNVVTQKHSKLGGLI

SEQ ID NO: 2549 - protein, 20 aa, Artificial Sequence
  Synthetic peptide
  MISC_FEATURE (1)..(1): N-terminal acetylation
  MISC_FEATURE (20)..(20): C-terminal amidation
IEVGWYNVVTQKHSKLGMGI

SEQ ID NO: 2550 - protein, 20 aa, Artificial Sequence
  Synthetic peptide
  MISC_FEATURE (1)..(1): N-terminal acetylation
  MISC_FEATURE (20)..(20): C-terminal amidation
IEVGWYNVVTQKHSKLGMLG

SEQ ID NO: 2551 - protein, 20 aa, Artificial Sequence
  Synthetic peptide
  MISC_FEATURE (1)..(1): N-terminal acetylation
  MISC_FEATURE (20)..(20): C-terminal amidation
LEVGWYNVVTQKHSKLGMLI

SEQ ID NO: 2552 - protein, 20 aa, Artificial Sequence
  Synthetic peptide
  MISC_FEATURE (1)..(1): N-terminal acetylation
  MISC_FEATURE (20)..(20): C-terminal amidation
ILVGWYNVVTQKHSKLGMLI

SEQ ID NO: 2553 - protein, 20 aa, Artificial Sequence
  Synthetic peptide
  MISC_FEATURE (1)..(1): N-terminal acetylation
  MISC_FEATURE (20)..(20): C-terminal amidation
IELGWYNVVTQKHSKLGMLI

SEQ ID NO: 2554 - protein, 20 aa, Artificial Sequence
  Synthetic peptide
  MISC_FEATURE (1)..(1): N-terminal acetylation
  MISC_FEATURE (20)..(20): C-terminal amidation
IEVLWYNVVTQKHSKLGMLI

SEQ ID NO: 2555 - protein, 20 aa, Artificial Sequence
  Synthetic peptide
  MISC_FEATURE (1)..(1): N-terminal acetylation
  MISC_FEATURE (20)..(20): C-terminal amidation
IEVGLYNVVTQKHSKLGMLI

SEQ ID NO: 2556 - protein, 20 aa, Artificial Sequence
  Synthetic peptide
  MISC_FEATURE (1)..(1): N-terminal acetylation
  MISC_FEATURE (20)..(20): C-terminal amidation
IEVGWLNVVTQKHSKLGMLI

SEQ ID NO: 2557 - protein, 20 aa, Artificial Sequence
  Synthetic peptide
  MISC_FEATURE (1)..(1): N-terminal acetylation
  MISC_FEATURE (20)..(20): C-terminal amidation
IEVGWYLVVTQKHSKLGMLI

SEQ ID NO: 2558 - protein, 20 aa, Artificial Sequence
  Synthetic peptide
  MISC_FEATURE (1)..(1): N-terminal acetylation
  MISC_FEATURE (20)..(20): C-terminal amidation
IEVGWYNLVTQKHSKLGMLI

SEQ ID NO: 2559 - protein, 20 aa, Artificial Sequence
  Synthetic peptide
  MISC_FEATURE (1)..(1): N-terminal acetylation
  MISC_FEATURE (20)..(20): C-terminal amidation
IEVGWYNVLTQKHSKLGMLI

SEQ ID NO: 2560 - protein, 20 aa, Artificial Sequence
  Synthetic peptide
  MISC_FEATURE (1)..(1): N-terminal acetylation
  MISC_FEATURE (20)..(20): C-terminal amidation
IEVGWYNVVLQKHSKLGMLI

SEQ ID NO: 2561 - protein, 20 aa, Artificial Sequence
  Synthetic peptide
  MISC_FEATURE (1)..(1): N-terminal acetylation
  MISC_FEATURE (20)..(20): C-terminal amidation
IEVGWYNVVTLKHSKLGMLI

SEQ ID NO: 2562 - protein, 20 aa, Artificial Sequence
  Synthetic peptide
  MISC_FEATURE (1)..(1): N-terminal acetylation
  MISC_FEATURE (20)..(20): C-terminal amidation
IEVGWYNVVTQLHSKLGMLI

SEQ ID NO: 2563 - protein, 20 aa, Artificial Sequence
  Synthetic peptide
  MISC_FEATURE (1)..(1): N-terminal acetylation
  MISC_FEATURE (20)..(20): C-terminal amidation
IEVGWYNVVTQKLSKLGMLI

SEQ ID NO: 2564 - protein, 20 aa, Artificial Sequence
  Synthetic peptide
  MISC_FEATURE (1)..(1): N-terminal acetylation
  MISC_FEATURE (20)..(20): C-terminal amidation
IEVGWYNVVTQKHLKLGMLI

SEQ ID NO: 2565 - protein, 20 aa, Artificial Sequence
  Synthetic peptide
  MISC_FEATURE (1)..(1): N-terminal acetylation
  MISC_FEATURE (20)..(20): C-terminal amidation
IEVGWYNVVTQKHSLLGMLI

SEQ ID NO: 2566 - protein, 20 aa, Artificial Sequence
  Synthetic peptide
  MISC_FEATURE (1)..(1): N-terminal acetylation
  MISC_FEATURE (20)..(20): C-terminal amidation
IEVGWYNVVTQKHSKLLMLI

SEQ ID NO: 2567 - protein, 20 aa, Artificial Sequence
  Synthetic peptide
  MISC_FEATURE (1)..(1): N-terminal acetylation
  MISC_FEATURE (20)..(20): C-terminal amidation
IEVGWYNVVTQKHSKLGLLI

SEQ ID NO: 2568 - protein, 20 aa, Artificial Sequence
  Synthetic peptide
  MISC_FEATURE (1)..(1): N-terminal acetylation
  MISC_FEATURE (20)..(20): C-terminal amidation
IEVGWYNVVTQKHSKLGMLL

SEQ ID NO: 2569 - protein, 20 aa, Artificial Sequence
  Synthetic peptide
  MISC_FEATURE (1)..(1): N-terminal acetylation
  MISC_FEATURE (20)..(20): C-terminal amidation
KEVGWYNVVTQKHSKLGMLI

SEQ ID NO: 2570 - protein, 20 aa, Artificial Sequence
  Synthetic peptide
  MISC_FEATURE (1)..(1): N-terminal acetylation
  MISC_FEATURE (20)..(20): C-terminal amidation
IKVGWYNVVTQKHSKLGMLI

SEQ ID NO: 2571 - protein, 20 aa, Artificial Sequence
  Synthetic peptide
  MISC_FEATURE (1)..(1): N-terminal acetylation
  MISC_FEATURE (20)..(20): C-terminal amidation
IEKGWYNVVTQKHSKLGMLI

SEQ ID NO: 2572 - protein, 20 aa, Artificial Sequence
  Synthetic peptide
  MISC_FEATURE (1)..(1): N-terminal acetylation
  MISC_FEATURE (20)..(20): C-terminal amidation
IEVKWYNVVTQKHSKLGMLI

SEQ ID NO: 2573 - protein, 20 aa, Artificial Sequence
  Synthetic peptide
  MISC_FEATURE (1)..(1): N-terminal acetylation
  MISC_FEATURE (20)..(20): C-terminal amidation
IEVGKYNVVTQKHSKLGMLI

SEQ ID NO: 2574 - protein, 20 aa, Artificial Sequence
  Synthetic peptide
  MISC_FEATURE (1)..(1): N-terminal acetylation
  MISC_FEATURE (20)..(20): C-terminal amidation
IEVGWKNVVTQKHSKLGMLI

SEQ ID NO: 2575 - protein, 20 aa, Artificial Sequence
  Synthetic peptide
  MISC_FEATURE (1)..(1): N-terminal acetylation
  MISC_FEATURE (20)..(20): C-terminal amidation
IEVGWYKVVTQKHSKLGMLI

SEQ ID NO: 2576 - protein, 20 aa, Artificial Sequence
  Synthetic peptide
  MISC_FEATURE (1)..(1): N-terminal acetylation
  MISC_FEATURE (20)..(20): C-terminal amidation
IEVGWYNKVTQKHSKLGMLI

SEQ ID NO: 2577 - protein, 20 aa, Artificial Sequence
  Synthetic peptide
  MISC_FEATURE (1)..(1): N-terminal acetylation
  MISC_FEATURE (20)..(20): C-terminal amidation
IEVGWYNVKTQKHSKLGMLI

SEQ ID NO: 2578 - protein, 20 aa, Artificial Sequence
  Synthetic peptide
  MISC_FEATURE (1)..(1): N-terminal acetylation
  MISC_FEATURE (20)..(20): C-terminal amidation
IEVGWYNVVKQKHSKLGMLI

SEQ ID NO: 2579 - protein, 20 aa, Artificial Sequence
  Synthetic peptide
  MISC_FEATURE (1)..(1): N-terminal acetylation
  MISC_FEATURE (20)..(20): C-terminal amidation
IEVGWYNVVTKKHSKLGMLI

SEQ ID NO: 2580 - protein, 20 aa, Artificial Sequence
  Synthetic peptide
  MISC_FEATURE (1)..(1): N-terminal acetylation
  MISC_FEATURE (20)..(20): C-terminal amidation
IEVGWYNVVTQKKSKLGMLI

SEQ ID NO: 2581 - protein, 20 aa, Artificial Sequence
  Synthetic peptide
  MISC_FEATURE (1)..(1): N-terminal acetylation
  MISC_FEATURE (20)..(20): C-terminal amidation
IEVGWYNVVTQKHKKLGMLI

SEQ ID NO: 2582 - protein, 20 aa, Artificial Sequence
  Synthetic peptide
  MISC_FEATURE (1)..(1): N-terminal acetylation
  MISC_FEATURE (20)..(20): C-terminal amidation
IEVGWYNVVTQKHSKKGMLI

SEQ ID NO: 2583 - protein, 20 aa, Artificial Sequence
  Synthetic peptide
  MISC_FEATURE (1)..(1): N-terminal acetylation
  MISC_FEATURE (20)..(20): C-terminal amidation
IEVGWYNVVTQKHSKLKMLI

SEQ ID NO: 2584 - protein, 20 aa, Artificial Sequence
  Synthetic peptide
  MISC_FEATURE (1)..(1): N-terminal acetylation
  MISC_FEATURE (20)..(20): C-terminal amidation
IEVGWYNVVTQKHSKLGKLI

SEQ ID NO: 2585 - protein, 20 aa, Artificial Sequence
  Synthetic peptide
  MISC_FEATURE (1)..(1): N-terminal acetylation
  MISC_FEATURE (20)..(20): C-terminal amidation
IEVGWYNVVTQKHSKLGMKI

SEQ ID NO: 2586 - protein, 20 aa, Artificial Sequence
  Synthetic peptide
  MISC_FEATURE (1)..(1): N-terminal acetylation
  MISC_FEATURE (20)..(20): C-terminal amidation
IEVGWYNVVTQKHSKLGMLK

SEQ ID NO: 2587 - protein, 20 aa, Artificial Sequence
  Synthetic peptide
  MISC_FEATURE (1)..(1): N-terminal acetylation
  MISC_FEATURE (20)..(20): C-terminal amidation
FEVGWYNVVTQKHSKLGMLI

SEQ ID NO: 2588 - protein, 20 aa, Artificial Sequence
  Synthetic peptide
  MISC_FEATURE (1)..(1): N-terminal acetylation
  MISC_FEATURE (20)..(20): C-terminal amidation
IFVGWYNVVTQKHSKLGMLI

SEQ ID NO: 2589 - protein, 20 aa, Artificial Sequence
  Synthetic peptide
  MISC_FEATURE (1)..(1): N-terminal acetylation
  MISC_FEATURE (20)..(20): C-terminal amidation
IEFGWYNVVTQKHSKLGMLI

SEQ ID NO: 2590 - protein, 20 aa, Artificial Sequence
  Synthetic peptide
  MISC_FEATURE (1)..(1): N-terminal acetylation
  MISC_FEATURE (20)..(20): C-terminal amidation
IEVFWYNVVTQKHSKLGMLI

SEQ ID NO: 2591 - protein, 20 aa, Artificial Sequence
  Synthetic peptide
  MISC_FEATURE (1)..(1): N-terminal acetylation
  MISC_FEATURE (20)..(20): C-terminal amidation
IEVGFYNVVTQKHSKLGMLI

SEQ ID NO: 2592 - protein, 20 aa, Artificial Sequence
  Synthetic peptide
  MISC_FEATURE (1)..(1): N-terminal acetylation
  MISC_FEATURE (20)..(20): C-terminal amidation
IEVGWFNVVTQKHSKLGMLI

SEQ ID NO: 2593 - protein, 20 aa, Artificial Sequence
  Synthetic peptide
  MISC_FEATURE (1)..(1): N-terminal acetylation
  MISC_FEATURE (20)..(20): C-terminal amidation
IEVGWYFVVTQKHSKLGMLI

SEQ ID NO: 2594 - protein, 20 aa, Artificial Sequence
  Synthetic peptide
  MISC_FEATURE (1)..(1): N-terminal acetylation
  MISC_FEATURE (20)..(20): C-terminal amidation
IEVGWYNFVTQKHSKLGMLI

SEQ ID NO: 2595 - protein, 20 aa, Artificial Sequence
  Synthetic peptide
  MISC_FEATURE (1)..(1): N-terminal acetylation
  MISC_FEATURE (20)..(20): C-terminal amidation
IEVGWYNVFTQKHSKLGMLI

SEQ ID NO: 2596 - protein, 20 aa, Artificial Sequence
  Synthetic peptide
  MISC_FEATURE (1)..(1): N-terminal acetylation
  MISC_FEATURE (20)..(20): C-terminal amidation
IEVGWYNVVFQKHSKLGMLI

SEQ ID NO: 2597 - protein, 20 aa, Artificial Sequence
  Synthetic peptide
  MISC_FEATURE (1)..(1): N-terminal acetylation
  MISC_FEATURE (20)..(20): C-terminal amidation
IEVGWYNVVTFKHSKLGMLI

SEQ ID NO: 2598 - protein, 20 aa, Artificial Sequence
  Synthetic peptide
  MISC_FEATURE (1)..(1): N-terminal acetylation
  MISC_FEATURE (20)..(20): C-terminal amidation
IEVGWYNVVTQFHSKLGMLI

SEQ ID NO: 2599 - protein, 20 aa, Artificial Sequence
  Synthetic peptide
  MISC_FEATURE (1)..(1): N-terminal acetylation
  MISC_FEATURE (20)..(20): C-terminal amidation
IEVGWYNVVTQKFSKLGMLI

SEQ ID NO: 2600 - protein, 20 aa, Artificial Sequence
  Synthetic peptide
  MISC_FEATURE (1)..(1): N-terminal acetylation
  MISC_FEATURE (20)..(20): C-terminal amidation
IEVGWYNVVTQKHFKLGMLI

SEQ ID NO: 2601 - protein, 20 aa, Artificial Sequence
  Synthetic peptide
  MISC_FEATURE (1)..(1): N-terminal acetylation
  MISC_FEATURE (20)..(20): C-terminal amidation
IEVGWYNVVTQKHSFLGMLI

SEQ ID NO: 2602 - protein, 20 aa, Artificial Sequence
  Synthetic peptide
  MISC_FEATURE (1)..(1): N-terminal acetylation
  MISC_FEATURE (20)..(20): C-terminal amidation
IEVGWYNVVTQKHSKFGMLI

SEQ ID NO: 2603 - protein, 20 aa, Artificial Sequence
  Synthetic peptide
  MISC_FEATURE (1)..(1): N-terminal acetylation
  MISC_FEATURE (20)..(20): C-terminal amidation
IEVGWYNVVTQKHSKLFMLI

SEQ ID NO: 2604 - protein, 20 aa, Artificial Sequence
  Synthetic peptide
  MISC_FEATURE (1)..(1): N-terminal acetylation
  MISC_FEATURE (20)..(20): C-terminal amidation
IEVGWYNVVTQKHSKLGFLI

SEQ ID NO: 2605 - protein, 20 aa, Artificial Sequence
  Synthetic peptide
  MISC_FEATURE (1)..(1): N-terminal acetylation
  MISC_FEATURE (20)..(20): C-terminal amidation
IEVGWYNVVTQKHSKLGMFI

SEQ ID NO: 2606 - protein, 20 aa, Artificial Sequence
  Synthetic peptide
  MISC_FEATURE (1)..(1): N-terminal acetylation
  MISC_FEATURE (20)..(20): C-terminal amidation
IEVGWYNVVTQKHSKLGMLF

SEQ ID NO: 2607 - protein, 20 aa, Artificial Sequence
  Synthetic peptide
  MISC_FEATURE (1)..(1): N-terminal acetylation
  MISC_FEATURE (20)..(20): C-terminal amidation
PEVGWYNVVTQKHSKLGMLI

SEQ ID NO: 2608 - protein, 20 aa, Artificial Sequence
  Synthetic peptide
  MISC_FEATURE (1)..(1): N-terminal acetylation
  MISC_FEATURE (20)..(20): C-terminal amidation
IPVGWYNVVTQKHSKLGMLI

SEQ ID NO: 2609 - protein, 20 aa, Artificial Sequence
  Synthetic peptide
  MISC_FEATURE (1)..(1): N-terminal acetylation
  MISC_FEATURE (20)..(20): C-terminal amidation
IEPGWYNVVTQKHSKLGMLI

SEQ ID NO: 2610 - protein, 20 aa, Artificial Sequence
  Synthetic peptide
  MISC_FEATURE (1)..(1): N-terminal acetylation
  MISC_FEATURE (20)..(20): C-terminal amidation
IEVPWYNVVTQKHSKLGMLI

SEQ ID NO: 2611 - protein, 20 aa, Artificial Sequence
  Synthetic peptide
  MISC_FEATURE (1)..(1): N-terminal acetylation
  MISC_FEATURE (20)..(20): C-terminal amidation
IEVGPYNVVTQKHSKLGMLI

SEQ ID NO: 2612 - protein, 20 aa, Artificial Sequence
  Synthetic peptide
  MISC_FEATURE (1)..(1): N-terminal acetylation
  MISC_FEATURE (20)..(20): C-terminal amidation
IEVGWPNVVTQKHSKLGMLI

SEQ ID NO: 2613 - protein, 20 aa, Artificial Sequence
  Synthetic peptide
  MISC_FEATURE (1)..(1): N-terminal acetylation
  MISC_FEATURE (20)..(20): C-terminal amidation
IEVGWYPVVTQKHSKLGMLI

SEQ ID NO: 2614 - protein, 20 aa, Artificial Sequence
  Synthetic peptide
  MISC_FEATURE (1)..(1): N-terminal acetylation
  MISC_FEATURE (20)..(20): C-terminal amidation
IEVGWYNPVTQKHSKLGMLI

SEQ ID NO: 2615 - protein, 20 aa, Artificial Sequence
  Synthetic peptide
  MISC_FEATURE (1)..(1): N-terminal acetylation
  MISC_FEATURE (20)..(20): C-terminal amidation
IEVGWYNVPTQKHSKLGMLI

SEQ ID NO: 2616 - protein, 20 aa, Artificial Sequence
  Synthetic peptide
  MISC_FEATURE (1)..(1): N-terminal acetylation
  MISC_FEATURE (20)..(20): C-terminal amidation
IEVGWYNVVPQKHSKLGMLI

SEQ ID NO: 2617 - protein, 20 aa, Artificial Sequence
  Synthetic peptide
  MISC_FEATURE (1)..(1): N-terminal acetylation
  MISC_FEATURE (20)..(20): C-terminal amidation
IEVGWYNVVTPKHSKLGMLI

SEQ ID NO: 2618 - protein, 20 aa, Artificial Sequence
  Synthetic peptide
  MISC_FEATURE (1)..(1): N-terminal acetylation
  MISC_FEATURE (20)..(20): C-terminal amidation
IEVGWYNVVTQPHSKLGMLI

SEQ ID NO: 2619 - protein, 20 aa, Artificial Sequence
  Synthetic peptide
  MISC_FEATURE (1)..(1): N-terminal acetylation
  MISC_FEATURE (20)..(20): C-terminal amidation
IEVGWYNVVTQKPSKLGMLI

SEQ ID NO: 2620 - protein, 20 aa, Artificial Sequence
  Synthetic peptide
  MISC_FEATURE (1)..(1): N-terminal acetylation
  MISC_FEATURE (20)..(20): C-terminal amidation
IEVGWYNVVTQKHPKLGMLI

SEQ ID NO: 2621 - protein, 20 aa, Artificial Sequence
  Synthetic peptide
  MISC_FEATURE (1)..(1): N-terminal acetylation
  MISC_FEATURE (20)..(20): C-terminal amidation
IEVGWYNVVTQKHSPLGMLI

SEQ ID NO: 2622 - protein, 20 aa, Artificial Sequence
  Synthetic peptide
  MISC_FEATURE (1)..(1): N-terminal acetylation
  MISC_FEATURE (20)..(20): C-terminal amidation
IEVGWYNVVTQKHSKPGMLI

SEQ ID NO: 2623 - protein, 20 aa, Artificial Sequence
  Synthetic peptide
  MISC_FEATURE (1)..(1): N-terminal acetylation
  MISC_FEATURE (20)..(20): C-terminal amidation
IEVGWYNVVTQKHSKLPMLI

SEQ ID NO: 2624 - protein, 20 aa, Artificial Sequence
  Synthetic peptide
  MISC_FEATURE (1)..(1): N-terminal acetylation
  MISC_FEATURE (20)..(20): C-terminal amidation
IEVGWYNVVTQKHSKLGPLI

SEQ ID NO: 2625 - protein, 20 aa, Artificial Sequence
  Synthetic peptide
  MISC_FEATURE (1)..(1): N-terminal acetylation
  MISC_FEATURE (20)..(20): C-terminal amidation
IEVGWYNVVTQKHSKLGMPI

SEQ ID NO: 2626 - protein, 20 aa, Artificial Sequence
  Synthetic peptide
  MISC_FEATURE (1)..(1): N-terminal acetylation
  MISC_FEATURE (20)..(20): C-terminal amidation
IEVGWYNVVTQKHSKLGMLP

SEQ ID NO: 2627 - protein, 20 aa, Artificial Sequence
  Synthetic peptide
  MISC_FEATURE (1)..(1): N-terminal acetylation
  MISC_FEATURE (20)..(20): C-terminal amidation
SEVGWYNVVTQKHSKLGMLI

SEQ ID NO: 2628 - protein, 20 aa, Artificial Sequence
  Synthetic peptide
  MISC_FEATURE (1)..(1): N-terminal acetylation
  MISC_FEATURE (20)..(20): C-terminal amidation
ISVGWYNVVTQKHSKLGMLI

SEQ ID NO: 2629 - protein, 20 aa, Artificial Sequence
  Synthetic peptide
  MISC_FEATURE (1)..(1): N-terminal acetylation
  MISC_FEATURE (20)..(20): C-terminal amidation
IESGWYNVVTQKHSKLGMLI

SEQ ID NO: 2630 - protein, 20 aa, Artificial Sequence
  Synthetic peptide
  MISC_FEATURE (1)..(1): N-terminal acetylation
  MISC_FEATURE (20)..(20): C-terminal amidation
IEVSWYNVVTQKHSKLGMLI

SEQ ID NO: 2631 - protein, 20 aa, Artificial Sequence
  Synthetic peptide
  MISC_FEATURE (1)..(1): N-terminal acetylation
  MISC_FEATURE (20)..(20): C-terminal amidation
IEVGSYNVVTQKHSKLGMLI

SEQ ID NO: 2632 - protein, 20 aa, Artificial Sequence
  Synthetic peptide
  MISC_FEATURE (1)..(1): N-terminal acetylation
  MISC_FEATURE (20)..(20): C-terminal amidation
IEVGWSNVVTQKHSKLGMLI

SEQ ID NO: 2633 - protein, 20 aa, Artificial Sequence
  Synthetic peptide
  MISC_FEATURE (1)..(1): N-terminal acetylation
  MISC_FEATURE (20)..(20): C-terminal amidation
IEVGWYSVVTQKHSKLGMLI

SEQ ID NO: 2634 - protein, 20 aa, Artificial Sequence
  Synthetic peptide
  MISC_FEATURE (1)..(1): N-terminal acetylation
  MISC_FEATURE (20)..(20): C-terminal amidation
IEVGWYNSVTQKHSKLGMLI

SEQ ID NO: 2635 - protein, 20 aa, Artificial Sequence
  Synthetic peptide
  MISC_FEATURE (1)..(1): N-terminal acetylation
  MISC_FEATURE (20)..(20): C-terminal amidation
IEVGWYNVSTQKHSKLGMLI

SEQ ID NO: 2636 - protein, 20 aa, Artificial Sequence
  Synthetic peptide
  MISC_FEATURE (1)..(1): N-terminal acetylation
  MISC_FEATURE (20)..(20): C-terminal amidation
IEVGWYNVVSQKHSKLGMLI

SEQ ID NO: 2637 - protein, 20 aa, Artificial Sequence
  Synthetic peptide
  MISC_FEATURE (1)..(1): N-terminal acetylation
  MISC_FEATURE (20)..(20): C-terminal amidation
IEVGWYNVVTSKHSKLGMLI

SEQ ID NO: 2638 - protein, 20 aa, Artificial Sequence
  Synthetic peptide
  MISC_FEATURE (1)..(1): N-terminal acetylation
  MISC_FEATURE (20)..(20): C-terminal amidation
IEVGWYNVVTQSHSKLGMLI

SEQ ID NO: 2639 - protein, 20 aa, Artificial Sequence
  Synthetic peptide
  MISC_FEATURE (1)..(1): N-terminal acetylation
  MISC_FEATURE (20)..(20): C-terminal amidation
IEVGWYNVVTQKSSKLGMLI

SEQ ID NO: 2640 - protein, 20 aa, Artificial Sequence
  Synthetic peptide
  MISC_FEATURE (1)..(1): N-terminal acetylation
  MISC_FEATURE (20)..(20): C-terminal amidation
IEVGWYNVVTQKHSSLGMLI

SEQ ID NO: 2641 - protein, 20 aa, Artificial Sequence
  Synthetic peptide
  MISC_FEATURE (1)..(1): N-terminal acetylation
  MISC_FEATURE (20)..(20): C-terminal amidation
IEVGWYNVVTQKHSKSGMLI

SEQ ID NO: 2642 - protein, 20 aa, Artificial Sequence
  Synthetic peptide
  MISC_FEATURE (1)..(1): N-terminal acetylation
  MISC_FEATURE (20)..(20): C-terminal amidation
IEVGWYNVVTQKHSKLSMLI

SEQ ID NO: 2643 - protein, 20 aa, Artificial Sequence
  Synthetic peptide
  MISC_FEATURE (1)..(1): N-terminal acetylation
  MISC_FEATURE (20)..(20): C-terminal amidation
IEVGWYNVVTQKHSKLGSLI

SEQ ID NO: 2644 - protein, 20 aa, Artificial Sequence
  Synthetic peptide
  MISC_FEATURE (1)..(1): N-terminal acetylation
  MISC_FEATURE (20)..(20): C-terminal amidation
IEVGWYNVVTQKHSKLGMSI

SEQ ID NO: 2645 - protein, 20 aa, Artificial Sequence
  Synthetic peptide
  MISC_FEATURE (1)..(1): N-terminal acetylation
  MISC_FEATURE (20)..(20): C-terminal amidation
IEVGWYNVVTQKHSKLGMLS

SEQ ID NO: 2646 - protein, 17 aa, Artificial Sequence
  Synthetic peptide
  MISC_FEATURE (1)..(1): N-terminal acetylation
  MISC_FEATURE (17)..(17): C-terminal amidation
IEVGWYNVVTQKHSKLG

SEQ ID NO: 2647 - protein, 14 aa, Artificial Sequence
  Synthetic peptide
  MISC_FEATURE (1)..(1): N-terminal acetylation
  MISC_FEATURE (14)..(14): C-terminal amidation
IEVGWYNVVTQKHS

SEQ ID NO: 2648 - protein, 11 aa, Artificial Sequence
  Synthetic peptide
  MISC_FEATURE (1)..(1): N-terminal acetylation
  MISC_FEATURE (11)..(11): C-terminal amidation
IEVGWYNVVTQ

SEQ ID NO: 2649 - protein, 17 aa, Artificial Sequence
  Synthetic peptide
  MISC_FEATURE (1)..(1): N-terminal acetylation
  MISC_FEATURE (17)..(17): C-terminal amidation
GWYNVVTQKHSKLGMLI

SEQ ID NO: 2650 - protein, 14 aa, Artificial Sequence
  Synthetic peptide
  MISC_FEATURE (1)..(1): N-terminal acetylation
  MISC_FEATURE (14)..(14): C-terminal amidation
NVVTQKHSKLGMLI

SEQ ID NO: 2651 - protein, 11 aa, Artificial Sequence
  Synthetic peptide
  MISC_FEATURE (1)..(1): N-terminal acetylation
  MISC_FEATURE (11)..(11): C-terminal amidation
TQKHSKLGMLI

SEQ ID NO: 2652 - protein, 14 aa, Artificial Sequence
  Synthetic peptide
  MISC_FEATURE (1)..(1): N-terminal acetylation
  MISC_FEATURE (14)..(14): C-terminal amidation
GWYNVVTQKHSKLG

SEQ ID NO: 2653 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XKLYLWQRWPSPWVEVGWEFV

SEQ ID NO: 2654 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XHKYLWQRWPSPWVEVGWEFV

SEQ ID NO: 2655 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XHAYLWQRWPSPWVEVGWEFV

SEQ ID NO: 2656 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XHLYLWQAWPSPWVEVGWEFV

SEQ ID NO: 2657 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XHLYLWQSWPSPWVEVGWEFV

SEQ ID NO: 2658 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XHLYLWQRAPSPWVEVGWEFV

SEQ ID NO: 2659 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XHLYLWQRFPSPWVEVGWEFV

SEQ ID NO: 2660 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XHLYLWQRWPSPFVEVGWEFV

SEQ ID NO: 2661 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XHLYLWQRWPSPGVEVGWEFV

SEQ ID NO: 2662 - protein, 20 aa, Artificial Sequence
  Synthetic peptide
  MISC_FEATURE (1)..(1): N-terminal acetylation
  MISC_FEATURE (20)..(20): C-terminal amidation
KKYLWQAAPSPGVEVGWEFV

SEQ ID NO: 2663 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XKKYLWQAAPSPGVEVGWEFV

SEQ ID NO: 2664 - protein, 28 aa, Artificial Sequence
  Synthetic peptide
  MISC_FEATURE (1)..(1): N-terminal acetylation
  MISC_FEATURE (28)..(28): C-terminal amidation
IPDQCSPLPCNEDGYMSCKDGKASFTCT

SEQ ID NO: 2665 - protein, 17 aa, Artificial Sequence
  Synthetic peptide
  MISC_FEATURE (1)..(1): N-terminal acetylation
  MISC_FEATURE (17)..(17): C-terminal amidation
VYEVGWDHGNWDEIIWR

SEQ ID NO: 2666 - protein, 17 aa, Artificial Sequence
  Synthetic peptide
  MISC_FEATURE (1)..(1): N-terminal acetylation
  MISC_FEATURE (17)..(17): C-terminal amidation
VYEVGWDHGNWSEIIWR

SEQ ID NO: 2667 - protein, 17 aa, Artificial Sequence
  Synthetic peptide
  MISC_FEATURE (1)..(1): N-terminal acetylation
  MISC_FEATURE (17)..(17): C-terminal amidation
VYEVGWDHGDWYEIIWR

SEQ ID NO: 2668 - protein, 14 aa, Artificial Sequence
  Synthetic peptide
  MISC_FEATURE (1)..(1): N-terminal acetylation
  MISC_FEATURE (14)..(14): C-terminal amidation
VGWDHGNWDEIIWR

SEQ ID NO: 2669 - protein, 14 aa, Artificial Sequence
  Synthetic peptide
  MISC_FEATURE (1)..(1): N-terminal acetylation
  MISC_FEATURE (14)..(14): C-terminal amidation
VGWDHGNWSEIIWR

SEQ ID NO: 2670 - protein, 14 aa, Artificial Sequence
  Synthetic peptide
  MISC_FEATURE (1)..(1): N-terminal acetylation
  MISC_FEATURE (14)..(14): C-terminal amidation
VGWDHGDWYEIIWR

SEQ ID NO: 2671 - protein, 17 aa, Artificial Sequence
  Synthetic peptide
  MISC_FEATURE (1)..(1): N-terminal acetylation
  MISC_FEATURE (17)..(17): C-terminal amidation
WWWGPKAPMGLIEYGWE

SEQ ID NO: 2672 - protein, 17 aa, Artificial Sequence
  Synthetic peptide
  MISC_FEATURE (1)..(1): N-terminal acetylation
  MISC_FEATURE (17)..(17): C-terminal amidation
WWWGPKARMGLIEYGWL

SEQ ID NO: 2673 - protein, 17 aa, Artificial Sequence
  Synthetic peptide
  MISC_FEATURE (1)..(1): N-terminal acetylation
  MISC_FEATURE (17)..(17): C-terminal amidation
WWWGPKARMGLISYGWE

SEQ ID NO: 2674 - protein, 20 aa, Artificial Sequence
  Synthetic peptide
  MISC_FEATURE (1)..(1): N-terminal acetylation
  MISC_FEATURE (20)..(20): C-terminal amidation
GFVWEDLWGTVEIWIWTKKT

SEQ ID NO: 2675 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XWKIIVGWELFDTGETLWWKV

SEQ ID NO: 2676 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XVYEVGWDHGNWDEIIWRYPS

SEQ ID NO: 2677 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XVYEVGWDHGNWYEIIWRDPS

SEQ ID NO: 2678 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XYTVEVGWHTVHTGRDNYFWM

SEQ ID NO: 2679 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XYTVEVGWHTVHTGRDNPMWM

SEQ ID NO: 2680 - protein, 18 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (18)..(18): C-terminal amidation
XVYEVGWDHGDWYEIIWR

SEQ ID NO: 2681 - protein, 21 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XHKYLWQRWPSPWVEVGWEFV

SEQ ID NO: 2682 - protein, 31 aa, Artificial Sequence
  Synthetic peptide
  MISC_FEATURE (1)..(1): N-terminal acetylation
  MISC_FEATURE (31)..(31): C-terminal amidation
HKYLWQRWPSPWVEVGWDHGNWYEIIWRDPS

SEQ ID NO: 2683 - protein, 32 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (32)..(32): C-terminal amidation
XHKYLWQRWPSPWVEVGWDHGNWYEIIWRDPS

SEQ ID NO: 2684 - protein, 29 aa, Artificial Sequence
  Synthetic peptide
  MISC_FEATURE (1)..(1): N-terminal acetylation
  MISC_FEATURE (29)..(29): C-terminal amidation
HKYLWQRWPSPLVSAGWYDYNFDHYREFT

SEQ ID NO: 2685 - protein, 30 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (30)..(30): C-terminal amidation
XHKYLWQRWPSPLVSAGWYDYNFDHYREFT

SEQ ID NO: 2686 - protein, 29 aa, Artificial Sequence
  Synthetic peptide
  MISC_FEATURE (1)..(1): N-terminal acetylation
  MISC_FEATURE (29)..(29): C-terminal amidation
HKYLWQRWPSPLVEVGWYDYNFDHYREFT

SEQ ID NO: 2687 - protein, 30 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (30)..(30): C-terminal amidation
XHKYLWQRWPSPLVEVGWYDYNFDHYREFT

SEQ ID NO: 2688 - protein, 31 aa, Artificial Sequence
  Synthetic peptide
  MISC_FEATURE (1)..(1): N-terminal acetylation
  MISC_FEATURE (31)..(31): C-terminal amidation
HLYLWQAWPSPWVEVGWDHGNWYEIIWRDPS

SEQ ID NO: 2689 - protein, 32 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (32)..(32): C-terminal amidation
XHLYLWQAWPSPWVEVGWDHGNWYEIIWRDPS

SEQ ID NO: 2690 - protein, 29 aa, Artificial Sequence
  Synthetic peptide
  MISC_FEATURE (1)..(1): N-terminal acetylation
  MISC_FEATURE (29)..(29): C-terminal amidation
HLYLWQAWPSPLVSAGWYDYNFDHYREFT

SEQ ID NO: 2691 - protein, 30 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (30)..(30): C-terminal amidation
XHLYLWQAWPSPLVSAGWYDYNFDHYREFT

SEQ ID NO: 2692 - protein, 29 aa, Artificial Sequence
  Synthetic peptide
  MISC_FEATURE (1)..(1): N-terminal acetylation
  MISC_FEATURE (29)..(29): C-terminal amidation
HLYLWQAWPSPLVEVGWYDYNFDHYREFT

SEQ ID NO: 2693 - protein, 30 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (30)..(30): C-terminal amidation
XHLYLWQAWPSPLVEVGWYDYNFDHYREFT

SEQ ID NO: 2694 - protein, 21 aa, Artificial Sequence
  Synthetic peptide
  MISC_FEATURE (1)..(1): N-terminal acetylation
  MISC_FEATURE (21)..(21): C-terminal amidation
VYEVGWDHGNWYEIIWRDPSC

SEQ ID NO: 2695 - protein, 21 aa, Artificial Sequence
  Synthetic peptide
  MISC_FEATURE (1)..(1): N-terminal acetylation
  MISC_FEATURE (21)..(21): C-terminal amidation
CVYEVGWDHGNWYEIIWRDPS

SEQ ID NO: 2696 - protein, 23 aa, Artificial Sequence
  Synthetic peptide
  MISC_FEATURE (1)..(1): N-terminal acetylation
  MISC_FEATURE (20)..(20): C-terminal amidation
NCSLDNGGCTHYCLEEVGWRRCS

SEQ ID NO: 2697 - protein, 24 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XNCSLDNGGCTHYCLEEVGWRRCS

SEQ ID NO: 2698 - protein, 16 aa, Artificial Sequence
  Synthetic peptide
  MISC_FEATURE (1)..(1): N-terminal acetylation
  MISC_FEATURE (20)..(20): C-terminal amidation
GCTHYSLEEVGWRRCS

SEQ ID NO: 2699 - protein, 17 aa, Artificial Sequence
  Synthetic peptide
  MISC_FEATURE (1)..(1): N-terminal biotinyl
  MISC_FEATURE (1)..(1): Xaa is (13-Amino-4,7,10-trioxa-tridecyl)-succinamic acid (ttds)
  MISC_FEATURE (21)..(21): C-terminal amidation
XGCTHYSLEEVGWRRCS

SEQ ID NO: 2700 - protein, 20 aa, Artificial Sequence
  Synthetic peptide
  MISC_FEATURE (1)..(1): N-terminal acetylation
  MISC_FEATURE (20)..(20): C-terminal amidation
ELYLWQAWPSPWVEVGWEFV

SEQ ID NO: 2701 - protein, 20 aa, Artificial Sequence
  Synthetic peptide
  MISC_FEATURE (1)..(1): N-terminal acetylation
  MISC_FEATURE (20)..(20): C-terminal amidation
HEYLWQAWPSPWVEVGWEFV

SEQ ID NO: 2702 - protein, 20 aa, Artificial Sequence
  Synthetic peptide
  MISC_FEATURE (1)..(1): N-terminal acetylation
  MISC_FEATURE (20)..(20): C-terminal amidation
HLELWQAWPSPWVEVGWEFV

SEQ ID NO: 2703 - protein, 20 aa, Artificial Sequence
  Synthetic peptide
  MISC_FEATURE (1)..(1): N-terminal acetylation
  MISC_FEATURE (20)..(20): C-terminal amidation
HLYEWQAWPSPWVEVGWEFV

SEQ ID NO: 2704 - protein, 20 aa, Artificial Sequence
  Synthetic peptide
  MISC_FEATURE (1)..(1): N-terminal acetylation
  MISC_FEATURE (20)..(20): C-terminal amidation
HLYLEQAWPSPWVEVGWEFV

SEQ ID NO: 2705 - protein, 20 aa, Artificial Sequence
  Synthetic peptide
  MISC_FEATURE (1)..(1): N-terminal acetylation
  MISC_FEATURE (20)..(20): C-terminal amidation
HLYLWEAWPSPWVEVGWEFV

SEQ ID NO: 2706 - protein, 20 aa, Artificial Sequence
  Synthetic peptide
  MISC_FEATURE (1)..(1): N-terminal acetylation
  MISC_FEATURE (20)..(20): C-terminal amidation
HLYLWQEWPSPWVEVGWEFV

SEQ ID NO: 2707 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAEPSPWVEVGWEFV

SEQ ID NO: 2708 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWESPWVEVGWEFV

SEQ ID NO: 2709 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWPEPWVEVGWEFV

SEQ ID NO: 2710 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWPSEWVEVGWEFV

SEQ ID NO: 2711 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWPSPEVEVGWEFV

SEQ ID NO: 2712 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWPSPWEEVGWEFV

SEQ ID NO: 2713 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWPSPWVEEGWEFV

SEQ ID NO: 2714 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWPSPWVEVEWEFV

SEQ ID NO: 2715 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWPSPWVEVGEEFV

SEQ ID NO: 2716 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWPSPWVEVGWEEV

SEQ ID NO: 2717 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWPSPWVEVGWEFE

SEQ ID NO: 2718 - protein, 20 aa, Artificial Sequence
  Synthetic peptide
  MISC_FEATURE (1)..(1): N-terminal acetylation
  MISC_FEATURE (20)..(20): C-terminal amidation
HHYLWQAWPSPWVEVGWEFV

SEQ ID NO: 2719 - protein, 20 aa, Artificial Sequence
  Synthetic peptide
  MISC_FEATURE (1)..(1): N-terminal acetylation
  MISC_FEATURE (20)..(20): C-terminal amidation
HLHLWQAWPSPWVEVGWEFV

SEQ ID NO: 2720 - protein, 20 aa, Artificial Sequence
  Synthetic peptide
  MISC_FEATURE (1)..(1): N-terminal acetylation
  MISC_FEATURE (20)..(20): C-terminal amidation
HLYHWQAWPSPWVEVGWEFV

SEQ ID NO: 2721 - protein, 20 aa, Artificial Sequence
  Synthetic peptide
  MISC_FEATURE (1)..(1): N-terminal acetylation
  MISC_FEATURE (20)..(20): C-terminal amidation
HLYLHQAWPSPWVEVGWEFV

SEQ ID NO: 2722 - protein, 20 aa, Artificial Sequence
  Synthetic peptide
  MISC_FEATURE (1)..(1): N-terminal acetylation
  MISC_FEATURE (20)..(20): C-terminal amidation
HLYLWHAWPSPWVEVGWEFV

SEQ ID NO: 2723 - protein, 20 aa, Artificial Sequence
  Synthetic peptide
  MISC_FEATURE (1)..(1): N-terminal acetylation
  MISC_FEATURE (20)..(20): C-terminal amidation
HLYLWQHWPSPWVEVGWEFV

SEQ ID NO: 2724 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAHPSPWVEVGWEFV

SEQ ID NO: 2725 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWHSPWVEVGWEFV

SEQ ID NO: 2726 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWPHPWVEVGWEFV

SEQ ID NO: 2727 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWPSHWVEVGWEFV

SEQ ID NO: 2728 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWPSPHVEVGWEFV

SEQ ID NO: 2729 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWPSPWHEVGWEFV

SEQ ID NO: 2730 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWPSPWVHVGWEFV

SEQ ID NO: 2731 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWPSPWVEHGWEFV

SEQ ID NO: 2732 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWPSPWVEVHWEFV

SEQ ID NO: 2733 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWPSPWVEVGHEFV

SEQ ID NO: 2734 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWPSPWVEVGWHFV

SEQ ID NO: 2735 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWPSPWVEVGWEHV

SEQ ID NO: 2736 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWPSPWVEVGWEFH

SEQ ID NO: 2737 - protein, 20 aa, Artificial Sequence
  Synthetic peptide
  MISC_FEATURE (1)..(1): N-terminal acetylation
  MISC_FEATURE (20)..(20): C-terminal amidation
ILYLWQAWPSPWVEVGWEFV

SEQ ID NO: 2738 - protein, 20 aa, Artificial Sequence
  Synthetic peptide
  MISC_FEATURE (1)..(1): N-terminal acetylation
  MISC_FEATURE (20)..(20): C-terminal amidation
HIYLWQAWPSPWVEVGWEFV

SEQ ID NO: 2739 - protein, 20 aa, Artificial Sequence
  Synthetic peptide
  MISC_FEATURE (1)..(1): N-terminal acetylation
  MISC_FEATURE (20)..(20): C-terminal amidation
HLILWQAWPSPWVEVGWEFV

SEQ ID NO: 2740 - protein, 20 aa, Artificial Sequence
  Synthetic peptide
  MISC_FEATURE (1)..(1): N-terminal acetylation
  MISC_FEATURE (20)..(20): C-terminal amidation
HLYIWQAWPSPWVEVGWEFV

SEQ ID NO: 2741 - protein, 20 aa, Artificial Sequence
  Synthetic peptide
  MISC_FEATURE (1)..(1): N-terminal acetylation
  MISC_FEATURE (20)..(20): C-terminal amidation
HLYLIQAWPSPWVEVGWEFV

SEQ ID NO: 2742 - protein, 20 aa, Artificial Sequence
  Synthetic peptide
  MISC_FEATURE (1)..(1): N-terminal acetylation
  MISC_FEATURE (20)..(20): C-terminal amidation
HLYLWIAWPSPWVEVGWEFV

SEQ ID NO: 2743 - protein, 20 aa, Artificial Sequence
  Synthetic peptide
  MISC_FEATURE (1)..(1): N-terminal acetylation
  MISC_FEATURE (20)..(20): C-terminal amidation
HLYLWQIWPSPWVEVGWEFV

SEQ ID NO: 2744 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAIPSPWVEVGWEFV

SEQ ID NO: 2745 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWISPWVEVGWEFV

SEQ ID NO: 2746 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWPIPWVEVGWEFV

SEQ ID NO: 2747 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWPSIWVEVGWEFV

SEQ ID NO: 2748 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWPSPIVEVGWEFV

SEQ ID NO: 2749 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWPSPWIEVGWEFV

SEQ ID NO: 2750 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWPSPWVIVGWEFV

SEQ ID NO: 2751 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWPSPWVEIGWEFV

SEQ ID NO: 2752 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWPSPWVEVIWEFV

SEQ ID NO: 2753 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWPSPWVEVGIEFV

SEQ ID NO: 2754 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWPSPWVEVGWIFV

SEQ ID NO: 2755 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWPSPWVEVGWEIV

SEQ ID NO: 2756 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWPSPWVEVGWEFI

SEQ ID NO: 2757 - protein, 20 aa, Artificial Sequence
  Synthetic peptide
  MISC_FEATURE (1)..(1): N-terminal acetylation
  MISC_FEATURE (20)..(20): C-terminal amidation
MLYLWQAWPSPWVEVGWEFV

SEQ ID NO: 2758 - protein, 20 aa, Artificial Sequence
  Synthetic peptide
  MISC_FEATURE (1)..(1): N-terminal acetylation
  MISC_FEATURE (20)..(20): C-terminal amidation
HMYLWQAWPSPWVEVGWEFV

SEQ ID NO: 2759 - protein, 20 aa, Artificial Sequence
  Synthetic peptide
  MISC_FEATURE (1)..(1): N-terminal acetylation
  MISC_FEATURE (20)..(20): C-terminal amidation
HLMLWQAWPSPWVEVGWEFV

SEQ ID NO: 2760 - protein, 20 aa, Artificial Sequence
  Synthetic peptide
  MISC_FEATURE (1)..(1): N-terminal acetylation
  MISC_FEATURE (20)..(20): C-terminal amidation
HLYMWQAWPSPWVEVGWEFV

SEQ ID NO: 2761 - protein, 20 aa, Artificial Sequence
  Synthetic peptide
  MISC_FEATURE (1)..(1): N-terminal acetylation
  MISC_FEATURE (20)..(20): C-terminal amidation
HLYLMQAWPSPWVEVGWEFV

SEQ ID NO: 2762 - protein, 20 aa, Artificial Sequence
  Synthetic peptide
  MISC_FEATURE (1)..(1): N-terminal acetylation
  MISC_FEATURE (20)..(20): C-terminal amidation
HLYLWMAWPSPWVEVGWEFV

SEQ ID NO: 2763 - protein, 20 aa, Artificial Sequence
  Synthetic peptide
  MISC_FEATURE (1)..(1): N-terminal acetylation
  MISC_FEATURE (20)..(20): C-terminal amidation
HLYLWQMWPSPWVEVGWEFV

SEQ ID NO: 2764 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAMPSPWVEVGWEFV

SEQ ID NO: 2765 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWMSPWVEVGWEFV

SEQ ID NO: 2766 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWPMPWVEVGWEFV

SEQ ID NO: 2767 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWPSMWVEVGWEFV

SEQ ID NO: 2768 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWPSPMVEVGWEFV

SEQ ID NO: 2769 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWPSPWMEVGWEFV

SEQ ID NO: 2770 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWPSPWVMVGWEFV

SEQ ID NO: 2771 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWPSPWVEMGWEFV

SEQ ID NO: 2772 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWPSPWVEVMWEFV

SEQ ID NO: 2773 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWPSPWVEVGMEFV

SEQ ID NO: 2774 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWPSPWVEVGWMFV

SEQ ID NO: 2775 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWPSPWVEVGWEMV

SEQ ID NO: 2776 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWPSPWVEVGWEFM

SEQ ID NO: 2777 - protein, 20 aa, Artificial Sequence
  Synthetic peptide
  MISC_FEATURE (1)..(1): N-terminal acetylation
  MISC_FEATURE (20)..(20): C-terminal amidation
NLYLWQAWPSPWVEVGWEFV

SEQ ID NO: 2778 - protein, 20 aa, Artificial Sequence
  Synthetic peptide
  MISC_FEATURE (1)..(1): N-terminal acetylation
  MISC_FEATURE (20)..(20): C-terminal amidation
HNYLWQAWPSPWVEVGWEFV

SEQ ID NO: 2779 - protein, 20 aa, Artificial Sequence
  Synthetic peptide
  MISC_FEATURE (1)..(1): N-terminal acetylation
  MISC_FEATURE (20)..(20): C-terminal amidation
HLNLWQAWPSPWVEVGWEFV

SEQ ID NO: 2780 - protein, 20 aa, Artificial Sequence
  Synthetic peptide
  MISC_FEATURE (1)..(1): N-terminal acetylation
  MISC_FEATURE (20)..(20): C-terminal amidation
HLYNWQAWPSPWVEVGWEFV

SEQ ID NO: 2781 - protein, 20 aa, Artificial Sequence
  Synthetic peptide
  MISC_FEATURE (1)..(1): N-terminal acetylation
  MISC_FEATURE (20)..(20): C-terminal amidation
HLYLNQAWPSPWVEVGWEFV

SEQ ID NO: 2782 - protein, 20 aa, Artificial Sequence
  Synthetic peptide
  MISC_FEATURE (1)..(1): N-terminal acetylation
  MISC_FEATURE (20)..(20): C-terminal amidation
HLYLWNAWPSPWVEVGWEFV

SEQ ID NO: 2783 - protein, 20 aa, Artificial Sequence
  Synthetic peptide
  MISC_FEATURE (1)..(1): N-terminal acetylation
  MISC_FEATURE (20)..(20): C-terminal amidation
HLYLWQNWPSPWVEVGWEFV

SEQ ID NO: 2784 - protein, 20 aa, Artificial Sequence
  Synthetic peptide
  MISC_FEATURE (1)..(1): N-terminal acetylation
  MISC_FEATURE (20)..(20): C-terminal amidation
HLYLWQANPSPWVEVGWEFV

SEQ ID NO: 2785 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWNSPWVEVGWEFV

SEQ ID NO: 2786 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWPNPWVEVGWEFV

SEQ ID NO: 2787 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWPSNWVEVGWEFV

SEQ ID NO: 2788 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWPSPNVEVGWEFV

SEQ ID NO: 2789 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWPSPWNEVGWEFV

SEQ ID NO: 2790 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWPSPWVNVGWEFV

SEQ ID NO: 2791 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWPSPWVENGWEFV

SEQ ID NO: 2792 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWPSPWVEVNWEFV

SEQ ID NO: 2793 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWPSPWVEVGNEFV

SEQ ID NO: 2794 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWPSPWVEVGWNFV

SEQ ID NO: 2795 - protein, 20 aa, Artificial Sequence
  Synthetic peptide
  MISC_FEATURE (1)..(1): N-terminal acetylation
  MISC_FEATURE (1)..(1): Covalently bound to 400Mal-PEG
  MISC_FEATURE (20)..(20): C-terminal amidation
HLYLWQAWPSPWVEVGWENV

SEQ ID NO: 2796 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWPSPWVEVGWEFN

SEQ ID NO: 2797 - protein, 20 aa, Artificial Sequence
  Synthetic peptide
  MISC_FEATURE (1)..(1): N-terminal acetylation
  MISC_FEATURE (20)..(20): C-terminal amidation
QLYLWQAWPSPWVEVGWEFV

SEQ ID NO: 2798 - protein, 20 aa, Artificial Sequence
  Synthetic peptide
  MISC_FEATURE (1)..(1): N-terminal acetylation
  MISC_FEATURE (20)..(20): C-terminal amidation
HQYLWQAWPSPWVEVGWEFV

SEQ ID NO: 2799 - protein, 20 aa, Artificial Sequence
  Synthetic peptide
  MISC_FEATURE (1)..(1): N-terminal acetylation
  MISC_FEATURE (20)..(20): C-terminal amidation
HLQLWQAWPSPWVEVGWEFV

SEQ ID NO: 2800 - protein, 20 aa, Artificial Sequence
  Synthetic peptide
  MISC_FEATURE (1)..(1): N-terminal acetylation
  MISC_FEATURE (20)..(20): C-terminal amidation
HLYQWQAWPSPWVEVGWEFV

SEQ ID NO: 2801 - protein, 20 aa, Artificial Sequence
  Synthetic peptide
  MISC_FEATURE (1)..(1): N-terminal acetylation
  MISC_FEATURE (20)..(20): C-terminal amidation
HLYLQQAWPSPWVEVGWEFV

SEQ ID NO: 2802 - protein, 20 aa, Artificial Sequence
  Synthetic peptide
  MISC_FEATURE (1)..(1): N-terminal acetylation
  MISC_FEATURE (20)..(20): C-terminal amidation
HLYLWQQWPSPWVEVGWEFV

SEQ ID NO: 2803 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAQPSPWVEVGWEFV

SEQ ID NO: 2804 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWQSPWVEVGWEFV

SEQ ID NO: 2805 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWPQPWVEVGWEFV

SEQ ID NO: 2806 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWPSQWVEVGWEFV

SEQ ID NO: 2807 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWPSPQVEVGWEFV

SEQ ID NO: 2808 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWPSPWQEVGWEFV

SEQ ID NO: 2809 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWPSPWVQVGWEFV

SEQ ID NO: 2810 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWPSPWVEQGWEFV

SEQ ID NO: 2811 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWPSPWVEVQWEFV

SEQ ID NO: 2812 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWPSPWVEVGQEFV

SEQ ID NO: 2813 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWPSPWVEVGWQFV

SEQ ID NO: 2814 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWPSPWVEVGWEQV

SEQ ID NO: 2815 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWPSPWVEVGWEFQ

SEQ ID NO: 2816 - protein, 20 aa, Artificial Sequence
  Synthetic peptide
  MISC_FEATURE (1)..(1): N-terminal acetylation
  MISC_FEATURE (20)..(20): C-terminal amidation
RLYLWQAWPSPWVEVGWEFV

SEQ ID NO: 2817 - protein, 20 aa, Artificial Sequence
  Synthetic peptide
  MISC_FEATURE (1)..(1): N-terminal acetylation
  MISC_FEATURE (20)..(20): C-terminal amidation
HRYLWQAWPSPWVEVGWEFV

SEQ ID NO: 2818 - protein, 20 aa, Artificial Sequence
  Synthetic peptide
  MISC_FEATURE (1)..(1): N-terminal acetylation
  MISC_FEATURE (20)..(20): C-terminal amidation
HLRLWQAWPSPWVEVGWEFV

SEQ ID NO: 2819 - protein, 20 aa, Artificial Sequence
  Synthetic peptide
  MISC_FEATURE (1)..(1): N-terminal acetylation
  MISC_FEATURE (20)..(20): C-terminal amidation
HLYRWQAWPSPWVEVGWEFV

SEQ ID NO: 2820 - protein, 20 aa, Artificial Sequence
  Synthetic peptide
  MISC_FEATURE (1)..(1): N-terminal acetylation
  MISC_FEATURE (20)..(20): C-terminal amidation
HLYLRQAWPSPWVEVGWEFV

SEQ ID NO: 2821 - protein, 20 aa, Artificial Sequence
  Synthetic peptide
  MISC_FEATURE (1)..(1): N-terminal acetylation
  MISC_FEATURE (20)..(20): C-terminal amidation
HLYLWRAWPSPWVEVGWEFV

SEQ ID NO: 2822 - protein, 20 aa, Artificial Sequence
  Synthetic peptide
  MISC_FEATURE (1)..(1): N-terminal acetylation
  MISC_FEATURE (20)..(20): C-terminal amidation
HLYLWQARPSPWVEVGWEFV

SEQ ID NO: 2823 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWRSPWVEVGWEFV

SEQ ID NO: 2824 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWPRPWVEVGWEFV

SEQ ID NO: 2825 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWPSRWVEVGWEFV

SEQ ID NO: 2826 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWPSPRVEVGWEFV

SEQ ID NO: 2827 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWPSPWREVGWEFV

SEQ ID NO: 2828 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWPSPWVRVGWEFV

SEQ ID NO: 2829 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWPSPWVERGWEFV

SEQ ID NO: 2830 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWPSPWVEVRWEFV

SEQ ID NO: 2831 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWPSPWVEVGREFV

SEQ ID NO: 2832 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWPSPWVEVGWRFV

SEQ ID NO: 2833 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWPSPWVEVGWERV

SEQ ID NO: 2834 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWPSPWVEVGWEFR

SEQ ID NO: 2835 - protein, 20 aa, Artificial Sequence
  Synthetic peptide
  MISC_FEATURE (1)..(1): N-terminal acetylation
  MISC_FEATURE (20)..(20): C-terminal amidation
TLYLWQAWPSPWVEVGWEFV

SEQ ID NO: 2836 - protein, 20 aa, Artificial Sequence
  Synthetic peptide
  MISC_FEATURE (1)..(1): N-terminal acetylation
  MISC_FEATURE (20)..(20): C-terminal amidation
HTYLWQAWPSPWVEVGWEFV

SEQ ID NO: 2837 - protein, 20 aa, Artificial Sequence
  Synthetic peptide
  MISC_FEATURE (1)..(1): N-terminal acetylation
  MISC_FEATURE (20)..(20): C-terminal amidation
HLTLWQAWPSPWVEVGWEFV

SEQ ID NO: 2838 - protein, 20 aa, Artificial Sequence
  Synthetic peptide
  MISC_FEATURE (1)..(1): N-terminal acetylation
  MISC_FEATURE (20)..(20): C-terminal amidation
HLYTWQAWPSPWVEVGWEFV

SEQ ID NO: 2839 - protein, 20 aa, Artificial Sequence
  Synthetic peptide
  MISC_FEATURE (1)..(1): N-terminal acetylation
  MISC_FEATURE (20)..(20): C-terminal amidation
HLYLTQAWPSPWVEVGWEFV

SEQ ID NO: 2840 - protein, 20 aa, Artificial Sequence
  Synthetic peptide
  MISC_FEATURE (1)..(1): N-terminal acetylation
  MISC_FEATURE (20)..(20): C-terminal amidation
HLYLWTAWPSPWVEVGWEFV

SEQ ID NO: 2841 - protein, 20 aa, Artificial Sequence
  Synthetic peptide
  MISC_FEATURE (1)..(1): N-terminal acetylation
  MISC_FEATURE (20)..(20): C-terminal amidation
HLYLWQTWPSPWVEVGWEFV

SEQ ID NO: 2842 - protein, 20 aa, Artificial Sequence
  Synthetic peptide
  MISC_FEATURE (1)..(1): N-terminal acetylation
  MISC_FEATURE (20)..(20): C-terminal amidation
HLYLWQATPSPWVEVGWEFV

SEQ ID NO: 2843 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWTSPWVEVGWEFV

SEQ ID NO: 2844 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWPTPWVEVGWEFV

SEQ ID NO: 2845 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWPSTWVEVGWEFV

SEQ ID NO: 2846 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWPSPTVEVGWEFV

SEQ ID NO: 2847 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWPSPWTEVGWEFV

SEQ ID NO: 2848 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWPSPWVTVGWEFV

SEQ ID NO: 2849 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWPSPWVETGWEFV

SEQ ID NO: 2850 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWPSPWVEVTWEFV

SEQ ID NO: 2851 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWPSPWVEVGTEFV

SEQ ID NO: 2852 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWPSPWVEVGWTFV

SEQ ID NO: 2853 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWPSPWVEVGWETV

SEQ ID NO: 2854 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWPSPWVEVGWEFT

SEQ ID NO: 2855 - protein, 20 aa, Artificial Sequence
  Synthetic peptide
  MISC_FEATURE (1)..(1): N-terminal acetylation
  MISC_FEATURE (20)..(20): C-terminal amidation
VLYLWQAWPSPWVEVGWEFV

SEQ ID NO: 2856 - protein, 20 aa, Artificial Sequence
  Synthetic peptide
  MISC_FEATURE (1)..(1): N-terminal acetylation
  MISC_FEATURE (20)..(20): C-terminal amidation
HVYLWQAWPSPWVEVGWEFV

SEQ ID NO: 2857 - protein, 20 aa, Artificial Sequence
  Synthetic peptide
  MISC_FEATURE (1)..(1): N-terminal acetylation
  MISC_FEATURE (20)..(20): C-terminal amidation
HLVLWQAWPSPWVEVGWEFV

SEQ ID NO: 2858 - protein, 20 aa, Artificial Sequence
  Synthetic peptide
  MISC_FEATURE (1)..(1): N-terminal acetylation
  MISC_FEATURE (20)..(20): C-terminal amidation
HLYVWQAWPSPWVEVGWEFV

SEQ ID NO: 2859 - protein, 20 aa, Artificial Sequence
  Synthetic peptide
  MISC_FEATURE (1)..(1): N-terminal acetylation
  MISC_FEATURE (20)..(20): C-terminal amidation
HLYLVQAWPSPWVEVGWEFV

SEQ ID NO: 2860 - protein, 20 aa, Artificial Sequence
  Synthetic peptide
  MISC_FEATURE (1)..(1): N-terminal acetylation
  MISC_FEATURE (20)..(20): C-terminal amidation
HLYLWVAWPSPWVEVGWEFV

SEQ ID NO: 2861 - protein, 20 aa, Artificial Sequence
  Synthetic peptide
  MISC_FEATURE (1)..(1): N-terminal acetylation
  MISC_FEATURE (20)..(20): C-terminal amidation
HLYLWQVWPSPWVEVGWEFV

SEQ ID NO: 2862 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAVPSPWVEVGWEFV

SEQ ID NO: 2863 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWVSPWVEVGWEFV

SEQ ID NO: 2864 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWPVPWVEVGWEFV

SEQ ID NO: 2865 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWPSVWVEVGWEFV

SEQ ID NO: 2866 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWPSPVVEVGWEFV

SEQ ID NO: 2867 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWPSPWVVVGWEFV

SEQ ID NO: 2868 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWPSPWVEVVWEFV

SEQ ID NO: 2869 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWPSPWVEVGVEFV

SEQ ID NO: 2870 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWPSPWVEVGWVFV

SEQ ID NO: 2871 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWPSPWVEVGWEVV

SEQ ID NO: 2872 - protein, 20 aa, Artificial Sequence
  Synthetic peptide
  MISC_FEATURE (1)..(1): N-terminal acetylation
  MISC_FEATURE (20)..(20): C-terminal amidation
WLYLWQAWPSPWVEVGWEFV

SEQ ID NO: 2873 - protein, 20 aa, Artificial Sequence
  Synthetic peptide
  MISC_FEATURE (1)..(1): N-terminal acetylation
  MISC_FEATURE (20)..(20): C-terminal amidation
HWYLWQAWPSPWVEVGWEFV

SEQ ID NO: 2874 - protein, 20 aa, Artificial Sequence
  Synthetic peptide
  MISC_FEATURE (1)..(1): N-terminal acetylation
  MISC_FEATURE (20)..(20): C-terminal amidation
HLWLWQAWPSPWVEVGWEFV

SEQ ID NO: 2875 - protein, 20 aa, Artificial Sequence
  Synthetic peptide
  MISC_FEATURE (1)..(1): N-terminal acetylation
  MISC_FEATURE (20)..(20): C-terminal amidation
HLYWWQAWPSPWVEVGWEFV

SEQ ID NO: 2876 - protein, 20 aa, Artificial Sequence
  Synthetic peptide
  MISC_FEATURE (1)..(1): N-terminal acetylation
  MISC_FEATURE (20)..(20): C-terminal amidation
HLYLWWAWPSPWVEVGWEFV

SEQ ID NO: 2877 - protein, 20 aa, Artificial Sequence
  Synthetic peptide
  MISC_FEATURE (1)..(1): N-terminal acetylation
  MISC_FEATURE (20)..(20): C-terminal amidation
HLYLWQWWPSPWVEVGWEFV

SEQ ID NO: 2878 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWWSPWVEVGWEFV

SEQ ID NO: 2879 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWPWPWVEVGWEFV

SEQ ID NO: 2880 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWPSWWVEVGWEFV

SEQ ID NO: 2881 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWPSPWWEVGWEFV

SEQ ID NO: 2882 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWPSPWVWVGWEFV

SEQ ID NO: 2883 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWPSPWVEWGWEFV

SEQ ID NO: 2884 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWPSPWVEVWWEFV

SEQ ID NO: 2885 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWPSPWVEVGWWFV

SEQ ID NO: 2886 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWPSPWVEVGWEWV

SEQ ID NO: 2887 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWPSPWVEVGWEFW

SEQ ID NO: 2888 - protein, 20 aa, Artificial Sequence
  Synthetic peptide
  MISC_FEATURE (1)..(1): N-terminal acetylation
  MISC_FEATURE (20)..(20): C-terminal amidation
YLYLWQAWPSPWVEVGWEFV

SEQ ID NO: 2889 - protein, 20 aa, Artificial Sequence
  Synthetic peptide
  MISC_FEATURE (1)..(1): N-terminal acetylation
  MISC_FEATURE (20)..(20): C-terminal amidation
HYYLWQAWPSPWVEVGWEFV

SEQ ID NO: 2890 - protein, 20 aa, Artificial Sequence
  Synthetic peptide
  MISC_FEATURE (1)..(1): N-terminal acetylation
  MISC_FEATURE (20)..(20): C-terminal amidation
HLYYWQAWPSPWVEVGWEFV

SEQ ID NO: 2891 - protein, 20 aa, Artificial Sequence
  Synthetic peptide
  MISC_FEATURE (1)..(1): N-terminal acetylation
  MISC_FEATURE (20)..(20): C-terminal amidation
HLYLYQAWPSPWVEVGWEFV

SEQ ID NO: 2892 - protein, 20 aa, Artificial Sequence
  Synthetic peptide
  MISC_FEATURE (1)..(1): N-terminal acetylation
  MISC_FEATURE (20)..(20): C-terminal amidation
HLYLWYAWPSPWVEVGWEFV

SEQ ID NO: 2893 - protein, 20 aa, Artificial Sequence
  Synthetic peptide
  MISC_FEATURE (1)..(1): N-terminal acetylation
  MISC_FEATURE (20)..(20): C-terminal amidation
HLYLWQYWPSPWVEVGWEFV

SEQ ID NO: 2894 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAYPSPWVEVGWEFV

SEQ ID NO: 2895 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWYSPWVEVGWEFV

SEQ ID NO: 2896 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWPYPWVEVGWEFV

SEQ ID NO: 2897 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWPSYWVEVGWEFV

SEQ ID NO: 2898 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWPSPYVEVGWEFV

SEQ ID NO: 2899 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWPSPWYEVGWEFV

SEQ ID NO: 2900 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWPSPWVYVGWEFV

SEQ ID NO: 2901 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWPSPWVEYGWEFV

SEQ ID NO: 2902 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWPSPWVEVYWEFV

SEQ ID NO: 2903 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWPSPWVEVGYEFV

SEQ ID NO: 2904 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWPSPWVEVGWYFV

SEQ ID NO: 2905 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWPSPWVEVGWEYV

SEQ ID NO: 2906 - protein, 20 aa, Artificial Sequence
  Synthetic peptide
  MISC_FEATURE (1)..(1): N-terminal acetylation
  MISC_FEATURE (20)..(20): C-terminal amidation
HLYLWQAWPSPWVEVGWEFY

SEQ ID NO: 2907 - protein, 21 aa, Artificial Sequence
  Synthetic peptide
  MISC_FEATURE (1)..(1): N-terminal acetylation
  MISC_FEATURE (21)..(21): N-ethylmaleiimido Cys
  MISC_FEATURE (21)..(21): C-terminal amidation
VYEVGWDHGNWYEIIWRDPSC

SEQ ID NO: 2908 - protein, 21 aa, Artificial Sequence
  Synthetic peptide
  MISC_FEATURE (1)..(1): N-terminal acetylation
  MISC_FEATURE (1)..(1): N-ethylmaleiimido Cys
  MISC_FEATURE (21)..(21): C-terminal amidation
CVYEVGWDHGNWYEIIWRDPS

SEQ ID NO: 2909 - protein, 20 aa, Artificial Sequence
  Synthetic peptide
  MISC_FEATURE (1)..(1): N-terminal acetylation
  MISC_FEATURE (20)..(20): C-terminal amidation
HKYLWQAWPSPWVEVGWEFV

SEQ ID NO: 2910 - protein, 20 aa, Artificial Sequence
  Synthetic peptide
  MISC_FEATURE (1)..(1): N-terminal acetylation
  MISC_FEATURE (20)..(20): C-terminal amidation
HPYLWQAWPSPWVEVGWEFV

SEQ ID NO: 2911 - protein, 20 aa, Artificial Sequence
  Synthetic peptide
  MISC_FEATURE (1)..(1): N-terminal acetylation
  MISC_FEATURE (20)..(20): C-terminal amidation
HTYLWQAHPSPNVEVGWEFV

SEQ ID NO: 2912 - protein, 20 aa, Artificial Sequence
  Synthetic peptide
  MISC_FEATURE (1)..(1): N-terminal acetylation
  MISC_FEATURE (20)..(20): C-terminal amidation
HTYLWQAHPSPEVEVGWEFV

SEQ ID NO: 2913 - protein, 20 aa, Artificial Sequence
  Synthetic peptide
  MISC_FEATURE (1)..(1): N-terminal acetylation
  MISC_FEATURE (20)..(20): C-terminal amidation
HTYLWQAYPSPNVEVGWEFV

SEQ ID NO: 2914 - protein, 20 aa, Artificial Sequence
  Synthetic peptide
  MISC_FEATURE (1)..(1): N-terminal acetylation
  MISC_FEATURE (20)..(20): C-terminal amidation
HTYLWQAYPSPEVEVGWEFV

SEQ ID NO: 2915 - protein, 20 aa, Artificial Sequence
  Synthetic peptide
  MISC_FEATURE (1)..(1): N-terminal acetylation
  MISC_FEATURE (20)..(20): C-terminal amidation
HTYLWQAHPSPEVEVGYEFV

SEQ ID NO: 2916 - protein, 20 aa, Artificial Sequence
  Synthetic peptide
  MISC_FEATURE (1)..(1): N-terminal acetylation
  MISC_FEATURE (20)..(20): C-terminal amidation
QTYLWQAHPSPEVEVGYEFV

SEQ ID NO: 2917 - protein, 636 aa, Homo sapiens
RANSLLEETKQGNLERECIEELCNKEEAREVFENDPETDYFYPKYLVCLRSFQTGLFTAARQSTNAYPDLRSCVNAIPDQCSPLPCNEDGYMSCKDGKASFTCTCKPGWQGEKCEFDINECKDPSNINGGCSQICDNTPGSYHCSCKNGFVMLSNKKDCKDVDECSLKPSICGTAVCKNIPGDFECECPEGYRYNLKSKSCEDIDECSENMCAQLCVNYPGGYTCYCDGKKGFKLAQDQKSCEVVSVCLPLNLDTKYELLYLAEQFAGVVLYLKFRLPEISRFSAEFDFRTYDSEGVILYAESIDHSAWLLIALRGGKIEVQLKNEHTSKITTGGDVINNGLWNMVSVEELEHSISIKIAKEAVMDINKPGPLFKPENGLLETKVYFAGFPRKVESELIKPINPRLDGCIRSWNLMKQGASGIKEIIQEKQNKHCLVTVEKGSYYPGSGIAQFHIDYNNVSSAEGWHVNVTLNIRPSTGTGVMLALVSGNNTVPFAVSLVDSTSEKSQDILLSVENTVIYRIQALSLCSDQQSHLEFRVNRNNLELSTPLKIETISHEDLQRQLAVLDKAMKAKVATYLGGLPDVPFSATPVNAFYNGCMEVNINGVQLDLDEAISKHNDIRAHSCPSVWKKTKNS

SEQ ID NO: 2918 - DNA, 3595 bp, Homo sapiens
  ref <308>: DATABASE ACCESSION NUMBER: NCBI / NM_000313.3
  ref <309>: DATABASE ENTRY DATE: 2014-02-14
  ref <313>: RELEVANT RESIDUES IN SEQ ID NO: (1)..(3595)
tttggaaacgtcacactgtggaggaaaagcagcaactagggagctggtgaagaaggatgtctcagcagtgtttactaggcctccaacactagagcccatcccccagctccgaaaagcttcctggaaatgtccttgttatcacttcccctctcgggctgggcgctgggagcgggcggtctcctccgcccccggctgttccgccgaggctcgctgggtcgctggcgccgccgcgcagcacggctcagaccgaggcgcacaggctcgcagctccgcggcgcctagcgctccggtccccgccgcgacgcgccaccgtccctgccggcgcctccgcgcgcttcgaaatgagggtcctgggtgggcgctgcggggcgctgctggcgtgtctcctcctagtgcttcccgtctcagaggcaaactttttgtcaaagcaacaggcttcacaagtcctggttaggaagcgtcgtgcaaattctttacttgaagaaaccaaacagggtaatcttgaaagagaatgcatcgaagaactgtgcaataaagaagaagccagggaggtctttgaaaatgacccggaaacggattatttttatccaaaatacttagtttgtcttcgctcttttcaaactgggttattcactgctgcacgtcagtcaactaatgcttatcctgacctaagaagctgtgtcaatgccattccagaccagtgtagtcctctgccatgcaatgaagatggatatatgagctgcaaagatggaaaagcttcttttacttgcacttgtaaaccaggttggcaaggagaaaagtgtgaatttgacataaatgaatgcaaagatccctcaaatataaatggaggttgcagtcaaatttgtgataatacacctggaagttaccactgttcctgtaaaaatggttttgttatgctttcaaataagaaagattgtaaagatgtggatgaatgctctttgaagccaagcatttgtggcacagctgtgtgcaagaacatcccaggagattttgaatgtgaatgccccgaaggctacagatataatctcaaatcaaagtcttgtgaagatatagatgaatgctctgagaacatgtgtgctcagctttgtgtcaattaccctggaggttacacttgctattgtgatgggaagaaaggattcaaacttgcccaagatcagaagagttgtgaggttgtttcagtgtgccttcccttgaaccttgacacaaagtatgaattactttacttggcggagcagtttgcaggggttgttttatatttaaaatttcgtttgccagaaatcagcagattttcagcagaatttgatttccggacatatgattcagaaggcgtgatactgtacgcagaatctatcgatcactcagcgtggctcctgattgcacttcgtggtggaaagattgaagttcagcttaagaatgaacatacatccaaaatcacaactggaggtgatgttattaataatggtctatggaatatggtgtctgtggaagaattagaacatagtattagcattaaaatagctaaagaagctgtgatggatataaataaacctggacccctttttaagccggaaaatggattgctggaaaccaaagtatactttgcaggattccctcggaaagtggaaagtgaactcattaaaccgattaaccctcgtctagatggatgtatacgaagctggaatttgatgaagcaaggagcttctggaataaaggaaattattcaagaaaaacaaaataagcattgcctggttactgtggagaagggctcctactatcctggttctggaattgctcaatttcacatagattataataatgtatccagtgctgagggttggcatgtaaatgtgaccttgaatattcgtccatccacgggcactggtgttatgcttgccttggtttctggtaacaacacagtgccctttgctgtgtccttggtggactccacctctgaaaaatcacaggatattctgttatctgttgaaaatactgtaatatatcggatacaggccctaagtctatgttccgatcaacaatctcatctggaatttagagtcaacagaaacaatctggagttgtcgacaccacttaaaatagaaaccatctcccatgaagaccttcaaagacaacttgccgtcttggacaaagcaatgaaagcaaaagtggccacatacctgggtggccttccagatgttccattcagtgccacaccagtgaatgccttttataatggctgcatggaagtgaatattaatggtgtacagttggatctggatgaagccatttctaaacataatgatattagagctcactcatgtccatcagtttggaaaaagacaaagaattcttaaggcatcttttctctgcttataataccttttccttgtgtgtaattatacttatgtttcaataacagctgaagggttttatttacaatgtgcagtctttgattattttgtggtcctttcctgggatttttaaaaggtcctttgtcaaggaaaaaaattctgttgtgatataaatcacagtaaagaaattcttacttctcttgctatctaagaatagtgaaaaataacaattttaaatttgaatttttttcctacaaatgacagtttcaatttttgtttgtaaaactaaattttaattttatcatcatgaactagtgtctaaatacctatgtttttttcagaaagcaaggaagtaaactcaaacaaaagtgcgtgtaattaaatactattaatcataggcagatactattttgtttatgtttttgtttttttcctgatgaaggcagaagagatggtggtctattaaatatgaattgaatggagggtcctaatgccttatttcaaaacaattcctcagggggaacagctttggcttcatctttctcttgtgtggcttcacatttaaaccagtatctttattgaattagaaaacaagtgggacatattttcctgagagcagcacaggaatcttcttcttggcagctgcagtctgtcaggatgagatatcagattaggttggataggtggggaaatctgaagtgggtacattttttaaattttgctgtgtgggtcacacaaggtctacattacaaaagacagaattcagggatggaaaggagaatgaacaaatgtgggagttcatagttttccttgaatccaacttttaattaccagagtaagttgccaaaatgtgattgttgaagtacaaaaggaactatgaaaaccagaacaaattttaacaaaaggacaaccacagagggatatagtgaatatcgtatcattgtaatcaaagaagtaaggaggtaagattgccacgtgcctgctggtactgtgatgcatttcaagtggcagttttatcacgtttgaatctaccattcatagccagatgtgtatcagatgtttcactgacagtttttaacaataaattcttttcactgtattttatatcacttataataaatcggtgtataattttaaaatgcatgtgaatatctttattatatcaactgtttgaataaaacaaaattacataatagacatttaactcttcaaaaaaaaaaaaaaaa

SEQ ID NO: 2919 - protein, 676 aa, Homo sapiens
  ref <308>: DATABASE ACCESSION NUMBER: NCBI / NP_000304.2
  ref <309>: DATABASE ENTRY DATE: 2014-02-14
  ref <313>: RELEVANT RESIDUES IN SEQ ID NO: (1)..(676)
MRVLGGRCGALLACLLLVLPVSEANFLSKQQASQVLVRKRRANSLLEETKQGNLERECIEELCNKEEAREVFENDPETDYFYPKYLVCLRSFQTGLFTAARQSTNAYPDLRSCVNAIPDQCSPLPCNEDGYMSCKDGKASFTCTCKPGWQGEKCEFDINECKDPSNINGGCSQICDNTPGSYHCSCKNGFVMLSNKKDCKDVDECSLKPSICGTAVCKNIPGDFECECPEGYRYNLKSKSCEDIDECSENMCAQLCVNYPGGYTCYCDGKKGFKLAQDQKSCEVVSVCLPLNLDTKYELLYLAEQFAGVVLYLKFRLPEISRFSAEFDFRTYDSEGVILYAESIDHSAWLLIALRGGKIEVQLKNEHTSKITTGGDVINNGLWNMVSVEELEHSISIKIAKEAVMDINKPGPLFKPENGLLETKVYFAGFPRKVESELIKPINPRLDGCIRSWNLMKQGASGIKEIIQEKQNKHCLVTVEKGSYYPGSGIAQFHIDYNNVSSAEGWHVNVTLNIRPSTGTGVMLALVSGNNTVPFAVSLVDSTSEKSQDILLSVENTVIYRIQALSLCSDQQSHLEFRVNRNNLELSTPLKIETISHEDLQRQLAVLDKAMKAKVATYLGGLPDVPFSATPVNAFYNGCMEVNINGVQLDLDEAISKHNDIRAHSCPSVWKKTKNS

SEQ ID NO: 2920 - protein, 16 aa, Artificial Sequence
  Synthetic peptide
VSAGWYDYNTDTYYEF

SEQ ID NO: 2921 - protein, 16 aa, Artificial Sequence
  Synthetic peptide
  MISC_FEATURE (1)..(1): Xaa is Ala, Cys, Asp, Glu, Phe, Gly, His, Ile, Lys, Leu, Met, Asn, Pro, D-Pro, Gln, Arg, Ser, Thr, Tle, Val, D-Val, Trp, or Tyr
  MISC_FEATURE (2)..(2): Xaa is Ala, Cys, Asp, Dap, Glu, Phe, Gly, His, Ile, Lys, Leu, Met, Asn, Pro, D-Pro, Gln, Arg, Ser, D-Ser, Thr, Val, Trp, or Tyr
  MISC_FEATURE (3)..(3): Xaa is Ala, D-Ala, Aib, Cys, Asp, Glu, Phe, Gly, His, Ile, Lys, Leu, Met, Asn, Pro, D-Pro, Gln, Arg, Ser, D-Ser, Thr, Tle, Val, Trp, or Tyr
  MISC_FEATURE (4)..(4): Xaa is Ala, D-Ala, Aib, Cys, Asp, Glu, Phe, Gly, His, Ile, Lys, Leu, Met, Asn, Nmg, Pro, D-Pro, Gln, Arg, Ser, D-Ser, Thr, Tle, Val, Trp, or Tyr
  MISC_FEATURE (5)..(5): Xaa is 1Ni, 2Ni, Ala, Bta, Cys, Asp, Glu, Phe, Gly, His, Ile, Lys, Leu, Met, Asn, Pro, D-Pro, Gln, Arg, Ser, Thr, Val, Trp, D-Trp, or Tyr
  MISC_FEATURE (6)..(6): Xaa is Ala, Cys, Asp, Glu, Phe, Gly, His, Ile, Lys, Leu, Met, Asn, Pro, D-Pro, Gln, Arg, Ser, Thr, Val, Trp, Tyr, or D-Trp
  MISC_FEATURE (7)..(7): Xaa is Ala, Cys, Asp, D-Asp, Glu, Phe, Gly, His, Ile, Lys, Leu, Met, Asn, Pro, D-Pro, Gln, Arg, Ser, Thr, Val, Trp, D-Trp, or Tyr
  MISC_FEATURE (8)..(8): Xaa is Ala, Cys, Asp, Glu, Phe, Gly, His, Ile, Lys, Leu, Met, Asn, Pro, D-Pro, Gln, Arg, Ser, Thr, Val, Trp, Tyr, or D-Trp
  MISC_FEATURE (9)..(9): Xaa is Ala, Cys, Asp, Glu, Phe, Gly, His, Ile, Lys, Leu, Met, Asn, D-Asn, Pro, D-Pro, Gln, Arg, Ser, Thr, Val, Trp, or Tyr
  MISC_FEATURE (10)..(10): Xaa is Ala, D-Ala, Cys, Asp, Glu, Phe, Gly, His, Ile, Lys, Leu, Met, Asn, Pro, D-Pro, Gln, Arg, Ser, Thr, D-Thr, Val, Trp, or Tyr
  MISC_FEATURE (11)..(11): Xaa is Ala, Cys, Asp, D-Asp, Glu, Phe, Gly, His, Ile, Lys, Leu, Met, Asn, Pro, D-Pro, Gln, Arg, Ser, Thr, Val, Trp, or Tyr
  MISC_FEATURE (12)..(12): Xaa is Ala, Cys, Asp, Glu, Phe, Gly, His, Ile, Lys, Leu, Met, Asn, Pro, D-Pro, Gln, Arg, Ser, Thr, D-Thr, Tle, Val, Trp, or Tyr
  MISC_FEATURE (13)..(13): Xaa is Ala, Cys, Asp, Glu, Phe, Gly, His, Ile, Lys, Leu, Met, Asn, Pro, D-Pro, Gln, Arg, Ser, Thr, Val, Trp, or Tyr
  MISC_FEATURE (14)..(14): Xaa is Ala, Cys, Asp, Glu, Phe, Gly, His, Ile, Lys, Leu, Met, Asn, Nle, Pro, D-Pro, Gln, Arg, Ser, Thr, Val, Trp, Tyr, or D-Tyr
  MISC_FEATURE (15)..(15): Xaa is Ala, Cys, Asp, Glu, D-Glu, Phe, Gly, His, Ile, Lys, Leu, Met, Asn, Pro, D-Pro, Gln, Arg, Ser, Thr, Val, Trp, or Tyr
  MISC_FEATURE (16)..(16): Xaa is Ala, Cys, Asp, Glu, Phe, D-Phe, Gly, His, Ile, Lys, Leu, Met, Asn, Pro, D-Pro, Gln, Arg, Ser, Thr, Val, Trp, or Tyr
XXXXXXXXXXXXXXXX

SEQ ID NO: 2922 - protein, 19 aa, Artificial Sequence
  Synthetic peptide
  MISC_FEATURE (1)..(1): Xaa is Ala, Cys, Asp, Glu, Phe, Gly, His, Ile, Lys, Leu, Met, Asn, Pro, D-Pro, Gln, Arg, Ser, Thr, Tle, Val, Trp, Tyr, or D-Tyr
  MISC_FEATURE (2)..(2): Xaa is Ala, Cys, Asp, Glu, Phe, Gly, His, Ile, Lys, Leu, Met, Asn, Pro, D-Pro, Gln, Arg, Ser, Thr, Val, D-Val, Trp, Tyr, or D-Tyr
  MISC_FEATURE (3)..(3): Xaa is Ala, Bpa, Cys, Asp, Glu, D-Glu, Phe, Gly, His, Ile, Lys, Leu, Met, Asn, Pro, D-Pro, Gln, Arg, Ser, Thr, Val, Trp, or Tyr
  MISC_FEATURE (4)..(4): Xaa is Ala, Cys, Asp, Glu, Phe, Gly, His, Ile, Lys, Leu, Met, Asn, Pro, D-Pro, Gln, Arg, Ser, Thr, Tle, Val, D-Val, Trp, or Tyr
  MISC_FEATURE (5)..(5): Xaa is Ala, Cys, Asp, Dap, Glu, Phe, Gly, His, Ile, Lys, Leu, Met, Asn, Pro, D-Pro, Gln, Arg, Ser, D-Ser, Thr, Val, Trp, or Tyr
  MISC_FEATURE (6)..(6): Xaa is Ala, D-Ala, Aib, Cys, Asp, Glu, Phe, Gly, His, Ile, Lys, Leu, Met, Asn, Pro, D-Pro, Gln, Arg, Ser, D-Ser, Thr, Tle, Val, Trp, or Tyr
  MISC_FEATURE (7)..(7): Xaa is Ala, D-Ala, Aib, Cys, Asp, Glu, Phe, Gly, His, Ile, Lys, Leu, Met, Asn, Nmg, Pro, D-Pro, Gln, Arg, Ser, D-Ser, Thr, Tle, Val, Trp, or Tyr
  MISC_FEATURE (8)..(8): Xaa is 1Ni, 2Ni, Ala, Bta, Cys, Asp, Glu, Phe, Gly, His, Ile, Lys, Leu, Met, Asn, Pro, D-Pro, Gln, Arg, Ser, Thr, Val, Trp, D-Trp, or Tyr
  MISC_FEATURE (9)..(9): Xaa is Ala, Cys, Asp, Glu, Phe, Gly, His, Ile, Lys, Leu, Met, Asn, Pro, D-Pro, Gln, Arg, Ser, Thr, Val, Trp, Tyr, or D-Trp
  MISC_FEATURE (10)..(10): Xaa is Ala, Cys, Asp, D-Asp, Glu, Phe, Gly, His, Ile, Lys, Leu, Met, Asn, Pro, D-Pro, Gln, Arg, Ser, Thr, Val, Trp, D-Trp, or Tyr
  MISC_FEATURE (11)..(11): Xaa is Ala, Cys, Asp, Glu, Phe, Gly, His, Ile, Lys, Leu, Met, Asn, Pro, D-Pro, Gln, Arg, Ser, Thr, Val, Trp, Tyr, or D-Trp
  MISC_FEATURE (12)..(12): Xaa is Ala, Cys, Asp, Glu, Phe, Gly, His, Ile, Lys, Leu, Met, Asn, D-Asn, Pro, D-Pro, Gln, Arg, Ser, Thr, Val, Trp, or Tyr
  MISC_FEATURE (13)..(13): Xaa is Ala, D-Ala, Cys, Asp, Glu, Phe, Gly, His, Ile, Lys, Leu, Met, Asn, Pro, D-Pro, Gln, Arg, Ser, Thr, D-Thr, Val, Trp, or Tyr
  MISC_FEATURE (14)..(14): Xaa is Ala, Cys, Asp, D-Asp, Glu, Phe, Gly, His, Ile, Lys, Leu, Met, Asn, Pro, D-Pro, Gln, Arg, Ser, Thr, Val, Trp, or Tyr
  MISC_FEATURE (15)..(15): Xaa is Ala, Cys, Asp, Glu, Phe, Gly, His, Ile, Lys, Leu, Met, Asn, Pro, D-Pro, Gln, Arg, Ser, Thr, D-Thr, Tle, Val, Trp, or Tyr
  MISC_FEATURE (16)..(16): Xaa is Ala, Cys, Asp, Glu, Phe, Gly, His, Ile, Lys, Leu, Met, Asn, Pro, D-Pro, Gln, Arg, Ser, Thr, Val, Trp, or Tyr
  MISC_FEATURE (17)..(17): Xaa is Ala, Cys, Asp, Glu, Phe, Gly, His, Ile, Lys, Leu, Met, Asn, Nle, Pro, D-Pro, Gln, Arg, Ser, Thr, Val, Trp, Tyr, or D-Tyr
  MISC_FEATURE (18)..(18): Xaa is Ala, Cys, Asp, Glu, D-Glu, Phe, Gly, His, Ile, Lys, Leu, Met, Asn, Pro, D-Pro, Gln, Arg, Ser, Thr, Val, Trp, or Tyr
  MISC_FEATURE (19)..(19): Xaa is Ala, Cys, Asp, Glu, Phe, D-Phe, Gly, His, Ile, Lys, Leu, Met, Asn, Pro, D-Pro, Gln, Arg, Ser, Thr, Val, Trp, or Tyr
XXXXXXXXXXXXXXXXXXX

SEQ ID NO: 2923 - protein, 20 aa, Artificial Sequence
  Synthetic peptide
  MISC_FEATURE (1)..(1): Xaa is Ala, Cys, Asp, Glu, Phe, Gly, His, Ile, Lys, Leu, Met, Asn, Pro, D-Pro, Gln, Arg, Ser, Thr, Tle, Val, Trp, Tyr, or D-Tyr
  MISC_FEATURE (2)..(2): Xaa is Ala, Cys, Asp, Glu, Phe, Gly, His, Ile, Lys, Leu, Met, Asn, Pro, D-Pro, Gln, Arg, Ser, Thr, Val, D-Val, Trp, Tyr, or D-Tyr
  MISC_FEATURE (3)..(3): Xaa is Ala, Bpa, Cys, Asp, Glu, D-Glu, Phe, Gly, His, Ile, Lys, Leu, Met, Asn, Pro, D-Pro, Gln, Arg, Ser, Thr, Val, Trp, or Tyr
  MISC_FEATURE (4)..(4): Xaa is Ala, Cys, Asp, Glu, Phe, Gly, His, Ile, Lys, Leu, Met, Asn, Pro, D-Pro, Gln, Arg, Ser, Thr, Tle, Val, D-Val, Trp, or Tyr
  MISC_FEATURE (5)..(5): Xaa is Ala, Cys, Asp, Dap, Glu, Phe, Gly, His, Ile, Lys, Leu, Met, Asn, Pro, D-Pro, Gln, Arg, Ser, D-Ser, Thr, Val, Trp, or Tyr
  MISC_FEATURE (6)..(6): Xaa is Ala, D-Ala, Aib, Cys, Asp, Glu, Phe, Gly, His, Ile, Lys, Leu, Met, Asn, Pro, D-Pro, Gln, Arg, Ser, D-Ser, Thr, Tle, Val, Trp, or Tyr
  MISC_FEATURE (7)..(7): Xaa is Ala, D-Ala, Aib, Cys, Asp, Glu, Phe, Gly, His, Ile, Lys, Leu, Met, Asn, Nmg, Pro, D-Pro, Gln, Arg, Ser, D-Ser, Thr, Tle, Val, Trp, or Tyr
  MISC_FEATURE (8)..(8): Xaa is 1Ni, 2Ni, Ala, Bta, Cys, Asp, Glu, Phe, Gly, His, Ile, Lys, Leu, Met, Asn, Pro, D-Pro, Gln, Arg, Ser, Thr, Val, Trp, D-Trp, or Tyr
  MISC_FEATURE (9)..(9): Xaa is Ala, Cys, Asp, Glu, Phe, Gly, His, Ile, Lys, Leu, Met, Asn, Pro, D-Pro, Gln, Arg, Ser, Thr, Val, Trp, Tyr, or D-Trp
  MISC_FEATURE (10)..(10): Xaa is Ala, Cys, Asp, D-Asp, Glu, Phe, Gly, His, Ile, Lys, Leu, Met, Asn, Pro, D-Pro, Gln, Arg, Ser, Thr, Val, Trp, D-Trp, or Tyr
  MISC_FEATURE (11)..(11): Xaa is Ala, Cys, Asp, Glu, Phe, Gly, His, Ile, Lys, Leu, Met, Asn, Pro, D-Pro, Gln, Arg, Ser, Thr, Val, Trp, Tyr, or D-Trp
  MISC_FEATURE (12)..(12): Xaa is Ala, Cys, Asp, Glu, Phe, Gly, His, Ile, Lys, Leu, Met, Asn, D-Asn, Pro, D-Pro, Gln, Arg, Ser, Thr, Val, Trp, or Tyr
  MISC_FEATURE (13)..(13): Xaa is Ala, D-Ala, Cys, Asp, Glu, Phe, Gly, His, Ile, Lys, Leu, Met, Asn, Pro, D-Pro, Gln, Arg, Ser, Thr, D-Thr, Val, Trp, or Tyr
  MISC_FEATURE (14)..(14): Xaa is Ala, Cys, Asp, D-Asp, Glu, Phe, Gly, His, Ile, Lys, Leu, Met, Asn, Pro, D-Pro, Gln, Arg, Ser, Thr, Val, Trp, or Tyr
  MISC_FEATURE (15)..(15): Xaa is Ala, Cys, Asp, Glu, Phe, Gly, His, Ile, Lys, Leu, Met, Asn, Pro, D-Pro, Gln, Arg, Ser, Thr, D-Thr, Tle, Val, Trp, or Tyr
  MISC_FEATURE (16)..(16): Xaa is Ala, Cys, Asp, Glu, Phe, Gly, His, Ile, Lys, Leu, Met, Asn, Pro, D-Pro, Gln, Arg, Ser, Thr, Val, Trp, or Tyr
  MISC_FEATURE (17)..(17): Xaa is Ala, Cys, Asp, Glu, Phe, Gly, His, Ile, Lys, Leu, Met, Asn, Nle, Pro, D-Pro, Gln, Arg, Ser, Thr, Val, Trp, Tyr, or D-Tyr
  MISC_FEATURE (18)..(18): Xaa is Ala, Cys, Asp, Glu, D-Glu, Phe, Gly, His, Ile, Lys, Leu, Met, Asn, Pro, D-Pro, Gln, Arg, Ser, Thr, Val, Trp, or Tyr
  MISC_FEATURE (19)..(19): Xaa is Ala, Cys, Asp, Glu, Phe, D-Phe, Gly, His, Ile, Lys, Leu, Met, Asn, Pro, D-Pro, Gln, Arg, Ser, Thr, Val, Trp, or Tyr
  MISC_FEATURE (20)..(20): Xaa is Ala, Cys, Asp, Glu, D-Glu, Phe, Gly, His, Ile, Lys, Leu, Met, Asn, Pro, D-Pro, Gln, Arg, Ser, Thr, Val, Trp, and Tyr
XXXXXXXXXXXXXXXXXXXX

SEQ ID NO: 2924 - protein, 20 aa, Artificial Sequence
  Synthetic peptide
EYYVSAGWYDYNTDTYYEFE

What is claimed is:

1. A peptide comprising an amino acid sequence at least 50% identical to the amino acid sequence EYYVSAGWYDYNTDTYYEFE (SEQ ID NO: 2924) and having the structure:

X1001-X1002-X1003-X1004-X1005-X1006-X1007-X1008-X1009-X1010-X1011-X1012-X1013-X1014-X1015-X1016-X1017-X1018-X1019-X2020, wherein X1001 is A, Bpa, C, D, E, e, F, G, H, I, K, L, M, N, P, p, Q, R, S, T, V, W, or Y;
wherein X1002 is A, C, D, E, F, G, H, I, K, L, M, N, P, p, Q, R, S, T, V, W, Y, or y;
wherein X1003 is A, C, D, E, F, G, H, I, K, L, M, N, P, p, Q, R, S, T, Tle, V, W, Y, or y;
wherein X1004 is F, I, L, Tle, V, or W;
wherein X1005 is A, E, F, G, H, I, K, L, M, R, S, T, V, W, or Y;
wherein X1006 is A, F, G, I, L, Tle V, W, or Y;
wherein X1007 is G or a;
wherein X1008 is F, 1Ni, 2Ni, Bta, or W;
wherein X1009 is F or Y;
wherein X1010 is D, E, F, H, I, K, L, N, Q, V, W, or Y;
wherein X1011 is F, G, I, K, L, M, R, T, V, W, or Y;
wherein X1012 is A, D, E, F, G, H, I, K, L, N, Q, R, S, T, V, or Y;
wherein X1013 is D, E, F, G, H, I, K, L, Q, R, S, T, V, or W;
wherein X1014 is D, E, or H;
wherein X1015 is D, E, H, I, K, M, Q, R, S, T, V, or W;
wherein X1016 is F, H, W, or Y;
wherein X1017 is D, E, G, H, I, T, W, or Y;
wherein X1018 is A, D, E, G, H, I, K, L, M, P, Q, R, S, T, V, or W;
wherein X1019 is F or W; and
wherein X2020 is A, C, D, E, e, F, G, H, I, K, L, M, N, P, p, Q, R, S, T, V, W, or Y.

2. The peptide of claim 1, wherein X1004 is V, X1005 is S, X1006 is A, X1007 is G, X1008 is W, and X1009 is Y.

3. The peptide of claim 1 comprising an amino acid sequence at least about 80% identical to the amino acid sequence EYYVSAGWYDYNTDTYYEFE (SEQ ID NO: 2924).

4. The peptide of claim 3, wherein the amino acid sequence comprises the amino acid sequence EYYVSAGWYDYNTDTYYEFE (SEQ ID NO: 2924).

5. The peptide of claim 1,
wherein X1003 is A, E, F, G, H, I, K, L, N, P, R, T, V, W, y, or Y; and
wherein X1002 is A, D, E, F, G, H, I, K, L, N, P, R, T, V, W, y, or Y.

6. The peptide of claim 1 comprising an amino acid sequence at least about 90% identical to the amino acid sequence EYYVSAGWYDYNTDTYYEFE (SEQ ID NO: 2924).

7. A peptide consisting of an amino acid sequence at least about 80% identical to EYYVSAGWYDYNTDTYYEFE (SEQ ID NO: 2924).

8. The peptide of claim 1, wherein the peptide is conjugated to a polyethylene glycol (PEG) moiety, albumin, an antibody or fragment thereof, hydroxyethyl starch, a proline-alanine-serine multimer, a C12-C18 fatty acid, or polysialic acid.

9. The peptide of claim 1, wherein the peptide is conjugated or attached to a moiety selected from the group consisting of Bpa, Bpa-K(Bio)-C, C(Atf-Bio), C(Atf-LC-Bio), C(FeBABE), C(MalCy5), C(NEM), C(PEG), K, K(Ac), K(Ttds), K(Ttds-γGlu), T, Ttds, or Ttds-K(Bio).

* * * * *